United States Patent 11,446,398 (REGULATED BIOCIRCUIT SYSTEMS) - sequence listing, part 57

SEQ ID NO: 151968 - DNA, 5605 bp, Homo sapiens
  Payload ID: 9917
  Gene Symbol: MTURN
  Gene Name: maturin, neural progenitor differentiation regulator homolog (Xenopus)
  Uniprot ID: Q8N3F0
  ENST ID: ENST00000324489
  CDS Start-End: 97-393
aggattttgaaggcaaaggctctggtttctccttccccatgtctgaaaaccgcccttagcctgcacaaggtgaacagtggaaatcattggtgaggaatggccacccactgccctctttactgtgtaggagcagatctgatgatgaacagagcaggtgagcacgtgtggagtgagagcgaggactgcctgcctttcttgcagctagcacaggattacatctcctcctgcggcaagaagacgctccacgaagtcctggaaaaagtcttcaagtctttcagacctttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatcaagatactcagacaactcacagaaacaacttctgtaataactggaaatactgctgttatcgtttagccaacaattacttactggggacatcctttgtaatgctaacatggaattattcctggacccttctgcatccctggttttagttaacctaggatgcggaatgcctcctttacaacactagattaaacctagcatctggggtgggtacgtttaaacagtcacacatgtgcctgttaggttgtgaaagttttgaattaaaaacaagcagtagcagcagaggccacagaacttatgggagtcttgtatatcttccaggcatgtcggtgtaaacctgattgtctcgacattttctgtttaattgattggtgctgtgaggagttcggctgctcgtggtaaaacagcgtactccagttttaagtcatcgggtaaaataataggacagtgatttccatctgtgcttcagtacccactttgtgttcttttcttgaaaagtcatactaaaggttaatttcaagtaaaatgaatttccttccaagtagcctattagtaaaacacaacttagtgtttcatccattggggtgagcatatactgccctttgcagccctgcctgtgttctgattggctccattcatgagcaaaggtgattgtgagctgtatattacacaggtgtcgcccaggtttcgtaacctccactttaatgcagtaagccgcaagaatgacttctgcaagtgaaatgaggaagcttcactagcttgctccattggaaggtaaactgaaattttatacgttgaagcttaaaatctaaatttatgtatgtttggaaatggaatggacattaacataaaatgtattttatcaaaaaagtgtttagactttgaccaaatacatgttggtattatcatgttaatgttctctgtttataaaaattgagtggagatagatagactcggccattctgtgggctgatgagaattctgggctttgttttgcaccaggggtaggaaacagagaacatgtctgtatgttacttaatctccatagcaaaatcccaaacagcattagcagatcgaattgtttcttctaagacttcctttttctgaatgtgtgcacatcccttctcgtgctcacacacttgcccacacactcacttcttcctgcgctgtggctgctctaagcagggctgtgcatggtgcaaagctgcagtcagtgagcctggcagcctgtggtttctgttatggaaatggttccatggtgaaacacatccctgacccttcacagacttacacatttactcaccaggaggtggcagcggtgtgggaggaggagtgttgaccttggacgcaggagagacacctgggttctagttcaagtcggccaaggactgtgtgaccttgacaagtctaactggtctgtgaacaaggggcatttgcccttccagctgtaaacactgcccttctgtgcctgccttatgtgtgtgtgtgagtaaggagcaacagtcaaggaaacttttagggattcgagaagaaaatacatgtgggatcttgccaaggtgctgcctttaggatgctgacccctgcactaccttagaacatgttgatctgtgagtgcccaagcccctgagggctcgatctcatggggcagatgaaattctcttccttagaggaaagggaaaggtgaggccccagaggacttatctcagctgtacatgctctgcctgtggagacatggcttttctttgtgctgtggcagactggggctttggaagtggtgtatgtttaacttacctgagagtgagagatgtgtaggaagaatagctggaagaaagtgaaagatgagtgccagtacttttggcctgttatccagtagagagaaagtgacagtgaaagtaacgtgagagagaaagagtgtgtgtgtatatgtgagagagagaaagaaagagaaaggaatgcttgattgcttgttgttcactgggccagctctgaaatccaaaatcatgccttgataacattacaaaaccgtgatcctgggtttgagtgaatcctagagacattgttcttatggccgcctggtttccgcagcctgatcaccatatcgagcagacgtcaaggaatcagagtgaagtacggagccagggagggaggtgaggccccgtgtagtgcctgtcaccactgtggattcacctgcactcaggtgtccactcctgtctcccaggcccaaagcagcacatggtgcaatggaaaagtctcttatgtagggatcctccttgtgtcctggtgccagaattagatttccagtgtacttcaacgaaaacctctctcctttatagttgctgtcatctttcatgtataaacagaaaccgtctctagcacaatatatttctgaatattgtttctgtttcataagagcacaatgtacatggacctaggggagctgtggtcccaagtgtcattggaatttatattttaggaataggctttgcatgttaaaattcacaagttgggaaactggtatgaacagatctgatttcttacagagaggcatgaaggaataggcaggacttaacttggggtgggaggagatgaataagggagaatgggagagttggggtctgacagttaccacctgagccccaggaaaactgttttcattttcacggctgtctcactgggggcctgctttcctcaaaggaactgactgtatgttgagaggcaatgccttgtgttggcatggctttgccactttaaaagtgccccccagccaaggagaccaacaggaaccctgctcatctggtagggctctttccttcagtaaaaccagctgccagcctgagaagcctgtctttcccaaatgcaggcagatctgagaggggctccaggcacccggcaggtaaatcacaaagcaaacttgggtgtccttggcagcggggaggaagcaggagtgccccctcaggccagagggcagggccaacctcctcactgtgcttcaaggttgtagaaagagcacaattaatgcttaagcgatcacagacccctctcccctgcagtgggtgttagctccaaagagatgccattgctgatcacccagtcttcggagaagcctaaaatttctttgaattaaaaactgatcctttttcataaagacccagtcacttctcccagtttagtgataacaggtatgacacaagaagctgaagtcttttagattttatagagagtaattctgaaacctgccagaatgctggtagcctgtggtgtccatggcaatgggtgtccatggtaaaatatctatagcttctgctcactgggcaaatataaaagacaacatattatttaacataatatgttgtcttttatatttttatttaaatctggattacgaaaatatagtacccatgagcatttcatgttagaaaccccatttaaagcactataaggctgaataggcacaagcgattaaaagtagatgccaggccacataaaaataaatgttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgtttttttttttttttaggcaagaagtgttgccggtagggtatgtgtgctttctttgccttcctatttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgaccatgtaattaccattcgcttgctattaaagagcctttcaaac

SEQ ID NO: 151969 - DNA, 843 bp, Homo sapiens
  Payload ID: 9917
  Gene Symbol: MTURN
  Gene Name: maturin, neural progenitor differentiation regulator homolog (Xenopus)
  Uniprot ID: Q8N3F0
  ENST ID: ENST00000409688
  CDS Start-End: 150-422
tccgcaccgcatgtaaacagtcccagccggcccagcccggccccggaggagcccgcgcaggccgagccgagcgccgcgctgcccgcccgggaggagggcgcctaggagcgggagggcgggcggcggcgggaggcgggcgcggggccgcgatggatttccagcagctggccgacgttgcggagaaatggtgctccaacacgcccttcgagctcatcgccaccgaggagaccgaacgcaggatggatttctacgccgaccccggcgtctccttctatgtgctgtgtccggacaacggctgcggcgacaattttttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcacttt

SEQ ID NO: 151970 - DNA, 555 bp, Homo sapiens
  Payload ID: 9917
  Gene Symbol: MTURN
  Gene Name: maturin, neural progenitor differentiation regulator homolog (Xenopus)
  ENST ID: ENST00000434060
  CDS Start-End: 326-555
gcaagaatggctcatggttctggatttcactggggagaagcccacacagccttcctgctgggaccgcccaggccatacccaaagaaatgactccaaagacagtaagtgggccaggaagacaaaaggctgttctcttgccatgaatatgtgtatccaaccatcgttcagaagtaagaagtattatattatttgtatcaggcctttctcttgaggccacccagattttaaatattttcccatctgcatgagaaaaatgcttgaaagtgtcatgtaaactgacaatttaaatagaatagatagaaagatagaggatgggggtgggcagatgattccttgggtagaatggaactttctccaagttctggaggctctaatggacaagatgccaacctcgggagttttcctagccggacctcttgaatctgtcccaggccagcacgtgtggagtgagagcgaggactgcctgcctttcttgcagctagcacaggattacatctcctcctgcggcaagaagacgctccacgaagtcctggaaaaagtcttcaagtctttcag

SEQ ID NO: 151971 - DNA, 4994 bp, Homo sapiens
  Payload ID: 9918
  Gene Symbol: MAU2
  Gene Name: MAU2 sister chromatid cohesion factor
  Uniprot ID: Q9Y6X3
  ENST ID: ENST00000262815
  CDS Start-End: 180-2021
aaccaaacggcgtcgcccttttacaccttcccggagcggcagtcatcccaaatacaaactacatgttccaggatgctttgggcggcagatctcgcggaagccgcgaggagagcccggccccgtctcgcgcgcctgcttccgcctccctgtggcggcggcttgttgttgtggaggccaaaatggcggctcaggcggcggcagcggcccaggcggcggcggcccaggctgcgcaggccgaggcggccgactcgtggtacctggcgcttctgggcttcgctgagcacttccgcacttccagcccgcccaaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcgtggttgatatcacagcaaatcccgcagttcgaagatgttaaatttgaagcagcaagtctgttgtctgaattgtactgtcaagagaattccgttgatgcagcaaagccgctgctgcggaaggcgatccagatctcacagcagaccccatattggcactgccgcctgctcttccagctcgctcaactgcacacgcttgagaaggacctggtgtcggcctgtgacctcctgggtgtaggggccgagtacgcccgggtggtgggatctgaatacacacgggcgctgttcctcctcagcaaggggatgctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgaagagcgtgaagccgtgtctgaagcagctgcagcagtgcatccagaccatctccacactgcacgatgatgagatcctgcccagcaaccccgctgacctcttccactggctgcccaaggagcacatgtgtgtgcttgtctacctggtgactgtgatgcactccatgcaggccggctacctggagaaggcgcagaagtacacggacaaggccctcatgcagctggagaagctcaagatgctggactgcagccccatcctgtcatccttccaagtgatcctgctggagcacatcatcatgtgccgccttgtcacgggtcacaaggccacggcgctgcaggagatctcccaggtctgccagctgtgccagcagtccccccggctcttctccaaccatgcagcacagctgcacacattgctgggcctgtactgtgtctctgtcaactgcatggacaacgcggaagcccagttcaccacggccctgcggctcaccaaccaccaggagctgtgggccttcatcgtcaccaacctggcgagtgtgtatatacgggaaggaaatagacaccaagaggtactctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacgtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggcgctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgcttggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactcaatatttaatattctactcgagctttatggaagccaaatcatgtgcatgtgtgtgtgtgcgtgtgtgcaagctttgaacctccttccacagccgcatcttctcatgacacaaagcttttgataagtactttcctgtgggtcgctcagcgcctcatagcatctcattcaattgcaagaatagaggccagacacggtggcgcatgcctgtagtcccagctaactgggaggctgaggcaggaggatcacttgagcccaggagattgaggctgcagtgagcatgatcgcgacactgcactccagcctgggtgacggtgagactttgtctcaaaaaaaaaaaaaaaaacaatggaaggcagacagcaagtccctgaggacacatcacacagtgtcctgtagctaagtgtctaggaaaaaacaaaaactccaaacccttcagtggatgaggacaaggtcgcagaaaggcattctgttgacagatgaacagccgaaagctggccagaccctcctgtatgcctctgcccttgtcctgtgggttgagggggtctgaccaggaggccacctacagcaggaagtgaggctgccatgtttccttgagacacagctgcctctccccagctctgtccctgtagtcacctgccggtgggcgaggatcctctccctgggataagcactcccagccccgtttatcagaaacacaggcaaggaaattggaactgccacccagcccagcatggtggctcaattggttggttgcgttgtcagttgtctcttcgttttgttaaggtttttaataagtacgtttggcataatgtcttttaatgggtttgtaatatttgtaacggttttagcagcctataacttttcagctggtgcttttacttagggaaaaaaacaatttgtaaatacagaacattgtttaaaagacataaccatagaacatagcttcctgtttgtggattttgtttcctatatattcaaagtaaaatgacttacaggagccac

SEQ ID NO: 151972 - DNA, 551 bp, Homo sapiens
  Payload ID: 9918
  Gene Symbol: MAU2
  Gene Name: MAU2 sister chromatid cohesion factor
  ENST ID: ENST00000609122
  CDS Start-End: 1-551
aaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcgaattccgttgatgcagcaaagccgctgctgcggaaggcgatccagatctcacagcagaccccatattggcactgccgcctgctcttccagctcgctcaactgcacacgcttgagaaggacctggtgtcggcctgtgacctcctgggtgtaggggccgagtacgcccgggtggtgggatctgaatacacacgggcgctgttcctcctcagcaaggggatgctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgaagagcgtgaagccgtgtctgaa

SEQ ID NO: 151973 - DNA, 707 bp, Homo sapiens
  Payload ID: 9918
  Gene Symbol: MAU2
  Gene Name: MAU2 sister chromatid cohesion factor
  ENST ID: ENST00000609060
  CDS Start-End: 1-707
gcgatccagatctcacagcagaccccatattggcactgccgcctgctcttccagctcgctcaactgcacacgcttgagaaggacctggtgtcggcctgtgacctcctgggtgtaggggccgagtacgcccgggtggtgggatctgaatacacacgggcgctgttcctcctcagcaaggggatgctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgaagagcgtgaagccgtgtctgaagcagctgcagcagtgcatccagaccatctccacactgcacgatgatgagatcctgcccagcaaccccgctgacctcttccactggctgcccaaggagcacatgtgtgtgcttgtctacctggtgactgtgatgcactccatgcaggccggctacctggagaaggcgcagaagtacacggacaaggccctcatgcagctggagaagctcaagagtaagtcagtgctggactgcagccccatcctgtcatccttccaagtgatcctgctggagcacatcatcatgtgccgccttgtcacgggtcacaaggccacggcgctgcaggagatctcccaggtctgcca

SEQ ID NO: 151974 - DNA, 5587 bp, Homo sapiens
  Payload ID: 9919
  Gene Symbol: MXD1
  Gene Name: MAX dimerization protein 1
  Uniprot ID: Q05195
  ENST ID: ENST00000264444
  CDS Start-End: 261-926
gagtcggggataaacactccgcggcggtggcggctgctgctctgctccgggttctgtcactgtgtcggcggtgcccagctcactggccccctccctctcttgtcgagcgtggttgccagagaggctccctcagccctgctccgcggggtccacagcgggctccacagcgggctccatagcgggctccacagcggtccggcggcggcagcgagcccgtgggcagtgggggttggtcccgtggctccggcccccggtgcagaatggcggcggcggttcggatgaacatccagatgctgctggaggcggccgactatctggagcggcgggagagagaagctgaacatggttatgcctccatgttaccatacaataacaaggacagagatgccttaaaacggaggaacaaatccaaaaagaataacagcagtagcagatcaactcacaatgaaatggagaagaatagacgggctcatcttcgcttgtgcctggagaagttgaaggggctggtgccacttggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatccactagcttctctttttctcgccataaaaatttgtctctgagagactatacattccaatcaatttgaagcatccaagaattcttagaccgaataagcaatgtccacatctcagcaatccccctctttgctctcctcgtgtcctctcccagacctttcttccagttttctggcttactgtgttacttgcctaggaggaatgtccaagtgtgtcttgtacttaggaaactgaaggaaacaaacttttgaaattgagatcctgatctcagaactccaaagtaagctttgaaagcagcatttaagagcacttaaccatggacctcaccaccagtgaggaagtcaggaatacctctagaaaacacgcccttcacaccgcgcatgctcattcccccgacgcgccgcgtgtggatgggagcagtatttctcactttaaaatggacaccttgatagtgtgtctctggggttgcacagctcatcaaagttccaaattgtttgttctcacaaacaaaacggtacaatctatttttgtgcgatgttcttgggacctcgctgtgttctgctatctcgaggcacattctcccctccaactttgttaatgctacttgtctctggaacatttttttttcctacctcagagataaatgagatctccatttcccacttaacacagtgattatccttttttccccccccaaaatagtgacatttggtccaattataatctattttcctattgaactttcagcaataactgagctgtggcactagcagagctagtagccattatcagtgaaagaaaaagtccacatttctactctctgttgcaggtgaacaggagaggatggtacactgttactagaactcctctccttattgattatttttggacacacccagaaacttctttatggaggcttttgggttgatagtttaaaaggctgatttttctttttggttatgatttctcccttaagtggtctccgactttgtagcatttttatttaagctaaaacagagcacatgtatatgtacataagacacattaaatctataaatactatttattcattttatataaactaatgtaatggaaaacaaattcttatgactttgtggttttatagatgttctagaaactttgtatgtaggtatctacaaaattagttcattcccctgaatatttttgcattcatatttttgaggtcttgatgttttcagcctctggcgaatctttttcattgaatttgaaccatttgtaaaatctgtgatgctgaagcagagtgtgtcacaaagtgatgagaacattactaaaatccacggacgcactgcgacctaagggctcaacggctgactcggcagcgggcagccaccccacgctcccctgcggtcactcgcacaccacagcctgaagctcccccagcgcctgcacctcgcacacagctaaggtcaaagttcaaacgcactccacacggaagctcattctatacccgaagagcagtctcagaaagcaagattacttttgtgttttttaaaaaatgattctttaatgtatttttctaaacattctgattggaagtagtggattcctaaatgattccaaagtcacctgtaattcttctgtttttgttttgttctgtcttttcttcattttggctttgggtggggggaggggcaggtgacacaaaggattttttttttttttttttaatttttggaatcttttccaataaccagctaaagatttgcactgaaatacaacttgtatgccttttgcatttttaaagcctgcttcctggatttaagcagagtgatagtgttcaaagagccagttcagcctgtaacatatttgaaaaagatatgtctgcactttgaggtcccttttgaatgccattcactagacctctcaagcattttgtttcattgctacatccaagcgcctcacaagtccacaatgcgggacagcatcaaaagctcaagactttggaaaaagcttgtgggcttgcactgggggagggaagggaacaaaatttgtgtacttctttgtttaatttagaaataaggcatccaagagatgccattattttctgtgtttcaattgttgtgcctttgagttaaactgcatttttgtcttttggttgaaatctgaaatgtactgtcccaatataaaacagtaattatttgacctttgcactgtttgtctggtccttttcagtttgattgcatataaatgtggaacttgatagatctctatatttttaatgcacttgtgataaactggcagcagggttagacattactttcaaagcttgaggtagaccgagtcagcatgctagacaggcttctctctctaaccaaaactgtaatcttcaggaccagcaaactcagcccaaggcagctaatccccccaaccccatcctccgcgccccgtgcggctgatcggcagccctgattcgccaatttgtcctctctcattcactgatccaccagcctgactgctaagagctatagtctttttagttgttttgtctttttaagcaagatgaaaacctttctattagggattttggggttgggaggggatgggcagagatataaaccccagcctttaagactttgacaattgtacgtaaatacagatgtgtataaatataggcacatgcatatttttatgtgaaagttgattttaaaaaactaaaaaaatctaaactgcactcttattgataccatcataacgcaagtgggaaaaataagagtacgcagtctaatttaatttcatgcagtgggaaaatatatatgtgtgcttctgtaacatcctgaaaacatagctttccatcccctgttggctttgaatggtgggccgagcacccaggtcgtctgtattttggttttcttttgctaagcagagatcttgaattcttcaaggtgctgatagcaactgctggctcctttctgtagtcacacacctaatgctagtttagtgattcaaaatgcatcacatttttaggcaggacctagattttccctgtcaacctaagatgaaaataatttcagtgttgattcagaactgaacattaagtaggccctcgtcctgcagttggccacttgagtgttttgttttgtttttattttttaaggtgggcattttcctttaacctctactttttcaaaagcaacaaaggggcctcaacctgagtttcctatgggcctctcttctgcatccccaaagcggccaagagcaaatcctgggggataagaaaaaagtgtaaactaggtaggattgtgatgctcaaaataaccatctagcaatatcttggagcttgagaatagattttgtgggcttatttcttcttgcctcttccccatcctttcaagagagaacttatttttgaaaagtatctatatatacacacacacacacacacacacatattattatttaggtttttataccatactgtattggcgagaataccactatcattgtcctttacagtctatttcttcccccaagtcttggtctttttttattttctattttttcatgaaccacacaggagactttaacatcctggtcttttctgtttcttctttgtttccccaagtttgtctgtccccctttgccttccctgagtgttgaacatcaggtagtaaaaggctaaacgcaatttcttgcatgtcaatctattctttttctatgtttgactctgatgcagtgtgtttagcgtgtctagtagctggctactcctatttaaaaactcttcctggtagaagacaacccaaagacccttttcgatgaggtggtttctcattctacatcctctgatctctatagactgtaggatgctttgctttcaaagataactgggttagagggtggggtgtgcaataggtgatttatcatggtttttttcattatcaatattacatggatgattttctcagattcttctgaaagaagaaattgacaggcactgctagattcagctattgaatggctgaagagattgagtatttgaccttctctcaaaatcataaagtgagaattcataaggcacccaatgttaagatttatccagatttttacattttgatttcttctctctgtggggtggcaagttgagggagcattcttcattttagcttttacctgacaaccaaacttgcctttaccccatccctagaattggtgctcttggaatattgctgttaccatcatttttggggggccatcttcctaatgctacacacagcctgacaggggagcagcagatgaaagggtatgctattctgtttccagatgtttctttatgtaaatatgacgccaatgtaaatcctgtgtcaagatcatagagaatggtgctttttactacagttagcacatgcatttttagaaactactacatgttttagagaatctttgctgtgtatatgtaaactgtattgttcaactgttaacaaataataaattatttcattattaaagaaa

SEQ ID NO: 151975 - DNA, 982 bp, Homo sapiens
  Payload ID: 9919
  Gene Symbol: MXD1
  Gene Name: MAX dimerization protein 1
  ENST ID: ENST00000409442
  CDS Start-End: 319-540
gctctgctccgggttctgtcactgtgtcggcggtgcccagctcactggccccctccctctcttgtcgagcgtggttgccagagaggctccctcagccctgctccgcggggtccacagcgggctccacagcgggctccatagcgggctccacagcggtccggcggcggcagcgagcccgtgggcagtgggggttggtcccgtggctccggcccccggtgcagaatggcggcggcggttcggatgaacatccagatgctgctggaggcggccgactatctggagcggcgggagagagaagctgaacatggttatgcctccatgttaccatacaataacaaggacagagatgccttaaaacggaggaacaaatccaaaaagaataacagcagtagcagacgggctcatcttcgcttgtgcctggagaagttgaaggggctggtgccacttggacccgaatcaagtcgacacactacgttgagtttattaacaaaagccaaattgcacataaaggacaagtacccccagcactggcgatgctgaagagtcagacgaagccaggagtcactggccagtcgacttcctgtctcagggagaagcttgatgagtggcaccgaaaggcgtctgaggaagtgtggcgcattccactgctagaagggaagatgcgggggccattgcccatttagagatctccctgtggggcccaacaactacccctttgacttgcagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagca

SEQ ID NO: 151976 - DNA, 860 bp, Homo sapiens
  Payload ID: 9919
  Gene Symbol: MXD1
  Gene Name: MAX dimerization protein 1
  ENST ID: ENST00000435990
  CDS Start-End: 316-860
aaagaagaggaagaagattatttcaggtagagggaagagctcatgaaaatgccatggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggattttgtattttgtatttaacttgcattcaaaaaacaggatctcagttctcctttcttgtaaaaagctgaacatggttatgcctccatgttaccatacaataacaaggacagagatgccttaaaacggaggaacaaatccaaaaagaataacagcagtagcagatcaactcacaatgaaatggagaagaatagacgggctcatcttcgcttgtgcctggagaagttgaaggggctggtgccacttggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacag

SEQ ID NO: 151977 - DNA, 5580 bp, Homo sapiens
  Payload ID: 9919
  Gene Symbol: MXD1
  Gene Name: MAX dimerization protein 1
  Uniprot ID: Q05195
  ENST ID: ENST00000540449
  CDS Start-End: 291-926
aagagaaggggctgggggcggggagatggtgagtcggggataaacactccgcggcggtggcggctgctgctctgctccgggttctgtcactgtgtcggcggtgcccagctcactggccccctccctctcttgtcgagcgtggttgccagagaggctccctcagccctgctccgcggggtccacagcgggctccacagcgggctccatagcgggctccacagcggtccggcggcggcagcgagcccgtgggcagtgggggttggtcccgtggctccggcccccggtgcagaatggcggcggcggttcggatgaacatccagatgctgctggaggcggccgactatctggagcggcgggagagagaagctgaacatggttatgcctccatgttaccatacaataacaaggacagagatgccttaaaacggaggaacaaatccaaaaagaataacagcagtagcagacgggctcatcttcgcttgtgcctggagaagttgaaggggctggtgccacttggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatccactagcttctctttttctcgccataaaaatttgtctctgagagactatacattccaatcaatttgaagcatccaagaattcttagaccgaataagcaatgtccacatctcagcaatccccctctttgctctcctcgtgtcctctcccagacctttcttccagttttctggcttactgtgttacttgcctaggaggaatgtccaagtgtgtcttgtacttaggaaactgaaggaaacaaacttttgaaattgagatcctgatctcagaactccaaagtaagctttgaaagcagcatttaagagcacttaaccatggacctcaccaccagtgaggaagtcaggaatacctctagaaaacacgcccttcacaccgcgcatgctcattcccccgacgcgccgcgtgtggatgggagcagtatttctcactttaaaatggacaccttgatagtgtgtctctggggttgcacagctcatcaaagttccaaattgtttgttctcacaaacaaaacggtacaatctatttttgtgcgatgttcttgggacctcgctgtgttctgctatctcgaggcacattctcccctccaactttgttaatgctacttgtctctggaacatttttttttcctacctcagagataaatgagatctccatttcccacttaacacagtgattatccttttttccccccccaaaatagtgacatttggtccaattataatctattttcctattgaactttcagcaataactgagctgtggcactagcagagctagtagccattatcagtgaaagaaaaagtccacatttctactctctgttgcaggtgaacaggagaggatggtacactgttactagaactcctctccttattgattatttttggacacacccagaaacttctttatggaggcttttgggttgatagtttaaaaggctgatttttctttttggttatgatttctcccttaagtggtctccgactttgtagcatttttatttaagctaaaacagagcacatgtatatgtacataagacacattaaatctataaatactatttattcattttatataaactaatgtaatggaaaacaaattcttatgactttgtggttttatagatgttctagaaactttgtatgtaggtatctacaaaattagttcattcccctgaatatttttgcattcatatttttgaggtcttgatgttttcagcctctggcgaatctttttcattgaatttgaaccatttgtaaaatctgtgatgctgaagcagagtgtgtcacaaagtgatgagaacattactaaaatccacggacgcactgcgacctaagggctcaacggctgactcggcagcgggcagccaccccacgctcccctgcggtcactcgcacaccacagcctgaagctcccccagcgcctgcacctcgcacacagctaaggtcaaagttcaaacgcactccacacggaagctcattctatacccgaagagcagtctcagaaagcaagattacttttgtgttttttaaaaaatgattctttaatgtatttttctaaacattctgattggaagtagtggattcctaaatgattccaaagtcacctgtaattcttctgtttttgttttgttctgtcttttcttcattttggctttgggtggggggaggggcaggtgacacaaaggattttttttttttttttttaatttttggaatcttttccaataaccagctaaagatttgcactgaaatacaacttgtatgccttttgcatttttaaagcctgcttcctggatttaagcagagtgatagtgttcaaagagccagttcagcctgtaacatatttgaaaaagatatgtctgcactttgaggtcccttttgaatgccattcactagacctctcaagcattttgtttcattgctacatccaagcgcctcacaagtccacaatgcgggacagcatcaaaagctcaagactttggaaaaagcttgtgggcttgcactgggggagggaagggaacaaaatttgtgtacttctttgtttaatttagaaataaggcatccaagagatgccattattttctgtgtttcaattgttgtgcctttgagttaaactgcatttttgtcttttggttgaaatctgaaatgtactgtcccaatataaaacagtaattatttgacctttgcactgtttgtctggtccttttcagtttgattgcatataaatgtggaacttgatagatctctatatttttaatgcacttgtgataaactggcagcagggttagacattactttcaaagcttgaggtagaccgagtcagcatgctagacaggcttctctctctaaccaaaactgtaatcttcaggaccagcaaactcagcccaaggcagctaatccccccaaccccatcctccgcgccccgtgcggctgatcggcagccctgattcgccaatttgtcctctctcattcactgatccaccagcctgactgctaagagctatagtctttttagttgttttgtctttttaagcaagatgaaaacctttctattagggattttggggttgggaggggatgggcagagatataaaccccagcctttaagactttgacaattgtacgtaaatacagatgtgtataaatataggcacatgcatatttttatgtgaaagttgattttaaaaaactaaaaaaatctaaactgcactcttattgataccatcataacgcaagtgggaaaaataagagtacgcagtctaatttaatttcatgcagtgggaaaatatatatgtgtgcttctgtaacatcctgaaaacatagctttccatcccctgttggctttgaatggtgggccgagcacccaggtcgtctgtattttggttttcttttgctaagcagagatcttgaattcttcaaggtgctgatagcaactgctggctcctttctgtagtcacacacctaatgctagtttagtgattcaaaatgcatcacatttttaggcaggacctagattttccctgtcaacctaagatgaaaataatttcagtgttgattcagaactgaacattaagtaggccctcgtcctgcagttggccacttgagtgttttgttttgtttttattttttaaggtgggcattttcctttaacctctactttttcaaaagcaacaaaggggcctcaacctgagtttcctatgggcctctcttctgcatccccaaagcggccaagagcaaatcctgggggataagaaaaaagtgtaaactaggtaggattgtgatgctcaaaataaccatctagcaatatcttggagcttgagaatagattttgtgggcttatttcttcttgcctcttccccatcctttcaagagagaacttatttttgaaaagtatctatatatacacacacacacacacacacacatattattatttaggtttttataccatactgtattggcgagaataccactatcattgtcctttacagtctatttcttcccccaagtcttggtctttttttattttctattttttcatgaaccacacaggagactttaacatcctggtcttttctgtttcttctttgtttccccaagtttgtctgtccccctttgccttccctgagtgttgaacatcaggtagtaaaaggctaaacgcaatttcttgcatgtcaatctattctttttctatgtttgactctgatgcagtgtgtttagcgtgtctagtagctggctactcctatttaaaaactcttcctggtagaagacaacccaaagacccttttcgatgaggtggtttctcattctacatcctctgatctctatagactgtaggatgctttgctttcaaagataactgggttagagggtggggtgtgcaataggtgatttatcatggtttttttcattatcaatattacatggatgattttctcagattcttctgaaagaagaaattgacaggcactgctagattcagctattgaatggctgaagagattgagtatttgaccttctctcaaaatcataaagtgagaattcataaggcacccaatgttaagatttatccagatttttacattttgatttcttctctctgtggggtggcaagttgagggagcattcttcattttagcttttacctgacaaccaaacttgcctttaccccatccctagaattggtgctcttggaatattgctgttaccatcatttttggggggccatcttcctaatgctacacacagcctgacaggggagcagcagatgaaagggtatgctattctgtttccagatgtttctttatgtaaatatgacgccaatgtaaatcctgtgtcaagatcatagagaatggtgctttttactacagttagcacatgcatttttagaaactactacatgttttagagaatctttgctgtgtatatgtaaactgtattgttcaactgttaacaaataataaattatttcattatt

SEQ ID NO: 151978 - DNA, 1534 bp, Homo sapiens
  Payload ID: 9920
  Gene Symbol: MXD3
  Gene Name: MAX dimerization protein 3
  Uniprot ID: Q9BW11
  ENST ID: ENST00000423571
  CDS Start-End: 66-1232
aaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcaggcctctcctctgagcgctcagactcagaccaaggtgagtgccccgaggctgaggggttgtgtggccctcggggcgagccaggtcttctgaccggacccctccccgcgcagaggagctggaggtggatgtggagagcctggtgtttgggggtgaggccgagctgctgcggggcttcgtcgccggccaggagcacagctactcgcacggcggcggcgcctggctatgatgttcctcacccagggcgggcctctgccctctactcgtgccaggcccacttgccaggcaggagccctccccaagccttcagggctgctcggagtcacctgttggaatggactaaaaggacccttgtgtgggaacaggtgctccccaaacaccctgctgctggctgccaggcaggccctctggaagggaaggggcaggactcatcaggacctccctggacccctgcagggcaggcagcttgggcccgagcccaagcatttggctctgctgcccccaaggggacaggaagcctcttgggcctcttcccttcctggacaaggccccctgcctttgcctcacataaactgtacagtattttcattaaaagcctctttcataacttcccgtccatagtcttgcctaatgaaaacgggggaactcccaaccacagacccactggaagaggaaataatatcagttcccatcactgacactgttggccgtgccaggcagtgcacttaattctcacaacttgaggctgttctgtctccacttcacggatggtagaaatgaggctgagtgacgtgactcgcctgaggtccaaaaacagtgaagccaagattcaaaccagagccttccgactccagagctggggccaactgaattcaacaagtatttattgagtgtctattatgtgctagatactgagacacatcagagaacaaaaccaaaagccctgcccttgtcgggcttacagtctagcacttaccgccagttaacctgcaggctacct

SEQ ID NO: 151979 - DNA, 1483 bp, Homo sapiens
  Payload ID: 9920
  Gene Symbol: MXD3
  Gene Name: MAX dimerization protein 3
  Uniprot ID: Q9BW11
  ENST ID: ENST00000439742
  CDS Start-End: 480-1100
cggccggaggccccgcccccgcggcacccacgtgcagcggctgggcccggcgctttcaggggaccaccaggcccccagagcgccgtgctatgttgggggctagtcactagcacggggctggaagctgagatcaaagacgccaatgagccggcgtgggtggatgagtgaggcgggcaagaagcagcaccggttagcctgagggttcgctccagggccaggcctggagccagcgcccttacctgcccctggaaagtctgagaccactcggggcggggcggctgccggagggtgggctgcggctccgtggcgggttccagaggggcggagccaagggctgggcgttcccgcgggcggggcgtcccgggggcggggcgggcccctgtgtttgttgcaccgtgtcagttactttgtaacaaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcaggcctctcctctgagcgctcagactcagaccaagaggagctggaggtggatgtggagagcctggtgtttgggggtgaggccgagctgctgcggggcttcgtcgccggccaggagcacagctactcgcacggcggcggcgcctggctatgatgttcctcacccagggcgggcctctgccctctactcgtgccaggcccacttgccaggcaggagccctccccaagccttcagggctgctcggagtcacctgttggaatggactaaaaggacccttgtgtgggaacaggtgctccccaaacaccctgctgctggctgccaggcaggccctctggaagggaaggggcaggactcatcaggacctccctggacccctgcagggcaggcagcttgggcccgagcccaagcatttggctctgctgcccccaaggggacaggaagcctcttgggcctcttcccttcctggacaaggccccctgcctttgcctcacataaactgtacagtattttcattaaaagcctctttcataacttcc

SEQ ID NO: 151980 - DNA, 2269 bp, Homo sapiens
  Payload ID: 9920
  Gene Symbol: MXD3
  Gene Name: MAX dimerization protein 3
  Uniprot ID: Q9BW11
  ENST ID: ENST00000427908
  CDS Start-End: 69-650
aacaaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcaggcctctcctctgagcgctcagactcagaccaagtcttgcctaatgaaaacgggggaactcccaaccacagacccactggaagaggaaataatatcagttcccatcactgacactgttggccgtgccaggcagtgcacttaattctcacaacttgaggctgttctgtctccacttcacggatggtagaaatgaggctgagtgacgtgactcgcctgaggtccaaaaacagtgaagccaagattcaaaccagagccttccgactccagagctggggccaactgaattcaacaagtatttattgagtgtctattatgtgctagatactgagacacatcagagaacaaaaccaaaagccctgcccttgtcgggcttacagtctagcacttaccgccagttaacctgcaggctacctggagccccgggcaagtcaccgcacctctgtgcctcggtcctcagctgcccaatgggagaataagcagacctggctcagacatgaatcatgtgcttggtgtactgcagatgccaaactgcatccccacaacccaccacgtagacagcagacagggctggaagttgatttttaatgataaagtacaatgaagggagggcagagaggctaagcctagctgtctggggtgctgtggtggtggtagactggctacacaaactgttgctgctgctgctgcttcttggtggccgccttgctggcgaggtccttggccttctctgtagctgccagtgccgtctcctttgccttctccttggcttccttggctgtctcaacaagtgttttggaaggggcctcgcctgtcgcgaacggcaggtggctgcctttagaagatgcctgaaagaccaacctaatttccctcccccatgacaccaatctcctctgggccaggctccactaaaaaggtggtattcaccctcctcccacccccagtacagacaaggagtcccagctcagagcagggcaatgactaacccagactccacgcccgctaggctgaatgagcctctccctatgaggaatatccacatacccagaaactcaccttgcagcttagccaagatatattcaaaacccttcatagtcttggtcacgttgcttttgaatcgggcaagaccaaattcctggcatgagatgagaatgggaaggatactgagttgcccactgaccccagcccagccccaacaccgaaagcactgggtcccagagccccagcagccccaacaacactgctcacctggacagctctggagacaccaaataagctagaggagacccaggcttcccggcggatttcagtccagccactgttgtcagagttcacacagtaaacacatcgttcctccaccacctatgcagaggccaaccacaatcgtggaacagtctttcattttgccaacttgcacataaatctgactccctgtcacttttcatgaggcgaagcaatacaatgaaaatccattccttcccctgactgcacctccaagtggcactgacagaacaagaagccataaataaggtcgttttgctctcgaaaacctctcttctgactcttaaactagaaggcaaaaggtctctctcttgagatcaacaaagggccttccagcccatcctgctcctggattttgttttgtgcatctagacgcatgcagtgttttagccgccttccaccagctgcagctctggagcttcctgacagtccaaataaaaacatttgcccgg

SEQ ID NO: 151981 - DNA, 861 bp, Homo sapiens
  Payload ID: 9920
  Gene Symbol: MXD3
  Gene Name: MAX dimerization protein 3
  Uniprot ID: Q9BW11
  ENST ID: ENST00000513063
  CDS Start-End: 88-708
gaaaaggccatttcgcgtgcctccaggtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcaggcctctcctctgagcgctcagactcagaccaagaggagctggaggtggatgtggagagcctggtgtttgggggtgaggccgagctgctgcggggcttcgtcgccggccaggagcacagctactcgcacggcggcggcgcctggctatgatgttcctcacccagggcgggcctctgccctctactcgtgccaggcccacttgccaggcaggagccctccccaagccttcagggctgctcggagtcacctgttggaatggactaaaaggacccttgtgtgggaacaggtgctccccaaacaccc

SEQ ID NO: 151982 - DNA, 440 bp, Homo sapiens
  Payload ID: 9920
  Gene Symbol: MXD3
  Gene Name: MAX dimerization protein 3
  ENST ID: ENST00000502529
  CDS Start-End: 67-440
caaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctgga

SEQ ID NO: 151983 - DNA, 555 bp, Homo sapiens
  Payload ID: 9920
  Gene Symbol: MXD3
  Gene Name: MAX dimerization protein 3
  ENST ID: ENST00000513169
  CDS Start-End: 332-555
ccgcttgctccggccggcaccctaggccggcccgccgccagctgtcgccgacatggaacccttggccagcaacatccaggtcctgctgcaggcggccgagttcctggagcgccgtgagagagcctgacgcgggcggggactctctctggcagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcagg

SEQ ID NO: 151984 - DNA, 4056 bp, Homo sapiens
  Payload ID: 9921
  Gene Symbol: MXD4
  Gene Name: MAX dimerization protein 4
  Uniprot ID: Q14582
  ENST ID: ENST00000337190
  CDS Start-End: 315-944
atcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggtcttcacacaacgagctagaaaagcacagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 151985 - DNA, 561 bp, Homo sapiens
  Payload ID: 9921
  Gene Symbol: MXD4
  Gene Name: MAX dimerization protein 4
  ENST ID: ENST00000510822
  CDS Start-End: 43-366
gcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacagcggcatcctgggaggcccgggagccctggctggcctgtggggtcctgcctggacacggaaggtggcctggagctgggagcgaggtccccctgcctcgttatcctccaggcagatgctgtggcacaccctgtggtgctgggaattgtgtgcccgcgtctgaatgggcaagacaggtcttcacacaacgagctagaaaagcacagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtc

SEQ ID NO: 151986 - DNA, 624 bp, Homo sapiens
  Payload ID: 9921
  Gene Symbol: MXD4
  Gene Name: MAX dimerization protein 4
  ENST ID: ENST00000513380
  CDS Start-End: 1-247
gctgcccttcgacggcgacttcgccagggagaaaacaaaggcggccggcctggtgcgcaaggccccgaacaacaggtcttcacacaacgagctagaaaagcacaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggac

SEQ ID NO: 151987 - DNA, 2424 bp, Homo sapiens
  Payload ID: 9922
  Gene Symbol: MXI1
  Gene Name: MAX interactor 1, dimerization protein
  Uniprot ID: P50539
  ENST ID: ENST00000239007
  CDS Start-End: 219-905
ggtaaacaaaccacgcgcgggctgcccgcggcacggcgggcgcggctggcgcggctggggcggcaggggcggcggagagcgcgccgagccgcggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaa

SEQ ID NO: 151988 - DNA, 3470 bp, Homo sapiens
  Payload ID: 9922
  Gene Symbol: MXI1
  Gene Name: MAX interactor 1, dimerization protein
  Uniprot ID: P50539
  ENST ID: ENST00000332674
  CDS Start-End: 205-1092
atacacacagactcacagcgagaccgacacacactcccatacactcacacacacaactgcaggcagcgaggctcgggaagtcaggccggcttttcgccccggcgccttctctgctccagccggccgggtctccctgggggcccggagctcggccgggccgcgcagccccgttagaggacgagctcggcggacccccgctcctccatgggcaaacgcgggcggccgcgcaaggaggcgcgctgcgagggcgcggggctggcccccgccgcgcccccggctgtgccccccgccgtggccgcgccccagcccccggccctgcccgaggaccccgctggggccaagcccaggtgccccttctcagacattttcaacaccagcgagaactcgatggagaagcacatcaacacttttctgcagaacgtgcagattctgctcgaggccgccagctacctggagcagatcgagaaagaaaacaaaaagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaa

SEQ ID NO: 151989 - DNA, 2188 bp, Homo sapiens
  Payload ID: 9922
  Gene Symbol: MXI1
  Gene Name: MAX interactor 1, dimerization protein
  Uniprot ID: P50539
  ENST ID: ENST00000361248
  CDS Start-End: 121-669
catcgcccgaggcgtccgccctgcaaatctgccagcccccgagaggggtttggaaccttagcacccaagtctaagtcaacttcatagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaa

SEQ ID NO: 151990 - DNA, 879 bp, Homo sapiens
  Payload ID: 9922
  Gene Symbol: MXI1
  Gene Name: MAX interactor 1, dimerization protein
  Uniprot ID: P50539
  ENST ID: ENST00000369612
  CDS Start-End: 240-818
ccctttagcggtggcagcccaaggggctgtagagatggcgcagaaagaccaggaactcggagactgtggtgtcgagagagaaaatgtctttctaagacttgttcgaagtacacaaaaatattgggcttaaagagactctttagaacagagagagttgaaagtaaaggggaatttttgaggcaagcgaagtcaatgaggtgaatgagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaa

SEQ ID NO: 151991 - DNA, 889 bp, Homo sapiens
  Payload ID: 9922
  Gene Symbol: MXI1
  Gene Name: MAX interactor 1, dimerization protein
  ENST ID: ENST00000393134
  CDS Start-End: 128-784
cggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaa

SEQ ID NO: 151992 - DNA, 803 bp, Homo sapiens
  Payload ID: 9922
  Gene Symbol: MXI1
  Gene Name: MAX interactor 1, dimerization protein
  ENST ID: ENST00000453116
  CDS Start-End: 126-803
gtcaggccggcttttcgccccggcgccttctctgctccagccggccgggtctccctgggggcccggagctcggccgggccgcgcagccccgttagaggacgagctcggcggacccccgctcctccatgggcaaacgcgggcggccgcgcaaggaggcgcgctgcgagggcgcggggctggcccccgccgcgcccccggctgtgccccccgccgtggccgcgccccagcccccggccctgcccgaggaccccgctggggccaagcccaggtgccccttctcagacattttcaacaccagcgagaactcgatggagaagcacatcaacacttttctgcagaacgtgcagattctgctcgaggccgccagctacctggagcagatcgagaaagaaaacaaaaagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgt

SEQ ID NO: 151993 - DNA, 634 bp, Homo sapiens
  Payload ID: 9922
  Gene Symbol: MXI1
  Gene Name: MAX interactor 1, dimerization protein
  ENST ID: ENST00000442296
  CDS Start-End: 281-634
gggtgctgggagataagaggaaggaggaacacggatgctggggggggtcaggggaagggacgaggccgggagaacactgagcgggggaaaaccggtggagaggggcctttgaatacctgcggggtgatgagatggggtccctttagcggtggcagcccaaggggctgtagagatggcgcagaaagaccaggaactcggagactgtggtgtcgagagagaaaatgtctttctaagacttgttcgaaagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaa

SEQ ID NO: 151994 - DNA, 4996 bp, Homo sapiens
  Payload ID: 9923
  Gene Symbol: MNT
  Gene Name: MAX network transcriptional repressor
  Uniprot ID: Q99583
  ENST ID: ENST00000174618
  CDS Start-End: 407-2155
cggcggccgggggcagcgcggctccttcccttgttgtgtgtgtcggtgcctcctcgccatcttgttgcaaagccctttcttgtcggcgggactcccgggggccgcggggcgggaggcatcggaagggaggtagagagggaggggaagaagggaggcagtgccgccttttttttttttttgcatcccatttttttaaatttgcaattttatattttgcaaatattttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggccgcagcctcggccccggcgcgcccccggcagctctcggcgcgatgagcatagagacgctactggaggcggcccgcttcctggaatggcaagcgcagcaacaacagagagcacgtgaggagcaggagcggcttcgcttggagcaggagcgagagcaggaacagaagaaggccaatagcctggccaggctggcacatacccttcctgtggaggaaccccgcatggaggcgccacccctgcctctgtctccaccggctcccccgccggcacccccaccaccacttgccacccctgccccactgactgtcatccctatccctgtggtgaccaactcccctcagcctctacccccacccccacccttgcccgcggcagcccagcctctgcccctggcgcctcgtcagccggccctggttggcgcccccggactcagcattaaggagcctgcccccctgcccagcaggccgcaggtgcccacccctgctcccctactgccggactcgaaggccaccattccacccaatggcagccccaagcctttgcagcccctccccacgcctgtcctgaccatagcgccacaccctggagtccagcctcagctggccccccagcagccgcccccacccacgctggggaccctgaagttggcaccagctgaagaagtcaaatccagtgaacagaagaagaggcccggggggatcggaaccagagaagtccacaacaaattggagaagaacaggagggcccatctgaaagagtgctttgagaccctgaagcggaacatccccaacgtggatgacaagaagacgtccaatctgagcgtgctgcggacggcgctgcggtacatccagtccctgaagaggaaggagaaggaatatgagcatgaaatggagcggctggcacgtgagaagattgccacgcagcagcggctggcagagctcaagcacgagctgagccagtggatggacgtactggagattgaccgcgtgctgcggcagacgggccagcccgaggatgaccaggcctccacctccaccgcctctgagggtgaggacaacatagacgaggatatggaggaggaccgggcgggcctgggcccacctaagctgagccatcgtccccagccggagctgctgaagtccaccctgccaccccccagcaccacccctgcgcctctgcctccacacccacaccctcacccccactccgtggccctacctcctgcccacctccccgtgcagcagcagcagccacagcagaagacccctctgccagcccctcctcccccaccggctgcccctgcccagacactggtgccagctccagcccatctggtggcgacggctgggggtggctccacggtcatcgcccacacagccaccactcacgcttcagtcatccagactgtgaaccacgttctgcaggggccaggcggcaagcacatcgcccacatcgccccctcggcccccagccctgcggtgcaactggcgcctgccacaccccccattgggcacatcactgtgcaccctgccaccctcaaccatgtggcccacctgggctcccagctgcccttgtacccgcagcccgtggcagtgagccacatcgcccacaccctctcgcaccagcaagtcaacggcacggccggcctggggcccccggctactgtcatggcaaagccggccgtgggggctcaggtggtgcaccacccccagctggtgggccagaccgtgctcaaccctgtgaccatggtcaccatgccctccttcccagtcagcacactcaagctggcttgaggacgaggccactcagaggcccccagtggggacagggagggggacctgtcccccactctctcacccaccagctccacacattccagccaggcccaggccagcccccccacccacccccaggcctcctaggggaagggggtgcaaagactctgagccaagggagggaagggccaccctgctgcactaggacttggtaagatgactctgagaaaatgcgagactctgatggaatgtgccacctgtccggcccagtgccagctccagtgccgctcctgcttcccctccctaccctcggaaatcagtgcgatgtggacgtcacgctccctgacttctcccccgccctgccccgccttcgtgtgctgctgctgctattgctgtctggtgaggtggcccaggcccccggctttcctccggagcctcatgttctcttcccaggcctttggaggggaaatggggaaagcagaactgaagccacttggcccagaaagctgcggattggggtgataaggggccttgctctgagcacaggtgacagatcataggaagtggctggtctggagtcccacccggacaggtggggcctcagcctggggctctctgacccggttgcagtcactgtgattcgttaccgtagatactacttaaaatgattctctaccaacaataaaccaaacccagccactgccaagcttcctgtgccctcaccccaatccctgccactgggctctggacctcaggagggcaggctgaggtggggaaggagggacttggctgtccttccccttccccgtcccctgcagcctgggtctggatgggaggagagccactgggcccctgtccccagtccccagtccccagccctgggcttggctcttggcttccagaaggcagcaaagaggggcgctgtcctgcgttcagcccctgatctctgacctctgctgagtgctgggcactgctccaagggacaggtgggcctggcggcctgtgggtttgggtgcctcctgcagtttgggagacatggaccagcatctggtcttgtttccaggagcatagaagccacatcgttgagacatcaggaaggtaaaaacccagcggcttagccaagccctaagcctgtccccagaccaaccctgggacctatacagaacagagggccagagctagggctgctgcttctgctccagcccctttgcctctgtcctcccatcccctcaacaccctgcttctcccggggacgcttttgagtgggccctgcccggggagctgcagagcagcagcacctttctctgagaagaggtccttggttgggtcaaggacagggctgagcgtggaagggggaggagtcaggggctctgtgttaggatgcggctttctctgcctctgggcagcctgctttggcctttccttgtatgtgggtgtttattacaagtggctttgtgtcagacacgctcggctccccacctggacacacactcaccagtggcctttcagtgtagcgggaggaagccggtgtccctggatgtgaagctcacactgatgggctggggcaggggcctgggccggcgagggggccggggggaggggacagagctgaggatttcctggagtgccctgcaggcacagaggaggtcagcaaaggtcttgaatagattttctctggaaataaagaatccttagatgcctaaaaattcccttcctgttccctcctggtcctggacacctcccaggggactgttccttatttctctctcctggtgtgggtaaagggacagttacaaaccaggtcaccatcctcagaggctgagccctgtacccaccccagcacagccacctccgccagaccccgtggctctgggagagccagctttgctattcccattgtgacagcgatggcaggcctgacccacggggcagttagagcagcctcgtggagctcgcccctcccctcagcctgcccacctctccctgcatcctgaggccagtggcccccgggcctgcacagatacctcatcatccacccgctgcccctccccgtccctgtcccccagcatcgggggcctgcaaatctagtgccgaatgactatgtccagattggtgacgatgggtgttgctgtttttcttgtcgtttgtgaacgctgtgatgctgtgtgcccaagtgggcagtcaccacccagcccttccttgggcgtctcccccagagtgctgtcgggaccacatctgtcctcaccctgtgggaccgcctggccctccctccctagcccttccagcctgggacacacacacacacacacacacacacacacgcacgcacacgcacacatcttacctctcatgcgtgttttaccttttgatgttcagagtggctcactggctgggagtccttacctcggggagagggggaggttggttccttggggggccaaagaaggcagggaatgcctggagggtaactggggggccaccatgaccccttctctctccagaaacagctgcttctccccccatcccagggtcccacccccaacccccagaggtggcccttgtttacagtgaggactcggccactgtgtctctgtttcctgaaatataaactgtagcgaccccagactgtagagatttttatgtgtttggatacatctgctgtgtggaaaaaaaaaaaaactacaaaaaccctaattttgtacatactgtatttttactattgaactgtattctagtggctgttcatgctccaagactttagttaccgagacatgaatactatccatgtaataagcacttgcctggaataaaatataaaactgaaataaacctgcactgaaacctgagatggagctgcca

SEQ ID NO: 151995 - DNA, 606 bp, Homo sapiens
  Payload ID: 9923
  Gene Symbol: MNT
  Gene Name: MAX network transcriptional repressor
  ENST ID: ENST00000575394
  CDS Start-End: 393-494
agcgcggctccttcccttgttgtgtgtgtcggtgcctcctcgccatcttgttgcaaagccctttcttgtcggcgggactcccgggggccgcggggcgggaggcatcggaagggaggtagagagggaggggaagaagggaggcagtgccgccttttttttttttttgcatcccatttttttaaatttgcaattttatattttgcaaatattttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggccgcagcctcggccccggcgcgcccccggcagctctcggcgcgatgagcatagagacgctactggaggcggcccgcttcctggaatggcaagcgcagcaacaacagagagcacgtgtccctgaagaggaaggagaaggaatatgagcatgaaatggagcggctggcacgtgagaagattgccacgcagcagcggctggcagagctcaagcacgagctgagccagtggatggacgtactggagattgaccgcgtgctg

SEQ ID NO: 151996 - DNA, 1420 bp, Homo sapiens
  Payload ID: 9924
  Gene Symbol: MBTD1
  Gene Name: mbt domain containing 1
  Uniprot ID: Q05BQ5
  ENST ID: ENST00000376381
  CDS Start-End: 98-1330
ctcacgagtggccctggagcaggaagtggtggagcagatcttccttgtttgggaggagcctgaggtggacctcgcgtcctgagtctggaaggcacctatggggacctgctggggtgatatctcagaaaatgtgagagtagaagttcccaatacagactgcagcctacctaccaaagtcttctggattgctggaattgtaaaattagcaggttacaatgcccttttaagatatgaaggatttgaaaatgactctggtctggacttctggtgcaatatatgtggttctgatatccatccagttggttggtgtgcagccagcggaaaacctcttgttcctcctagaactattcagcataaatatacaaactggaaagcttttctagtgaaacgacttactggtgccaaaacactgcctcctgatttctcccaaaaggtttcagagagtatgcagtatcctttcaaaccttgcatgagagtagaagtggttgacaagaggcatttgtgtcgaacacgagtagcagtggtggaaagtgtaattggaggaagattaagactagtgtatgaagaaagcgaagatagaacagatgacttctggtgccatatgcacagcccattaatacatcatattggttggtctcgaagcataggtcatcgattcaaaagatctgatattacaaagaaacaggatggacattttgatacaccaccacatttatttgctaaggtaaaagaagtagaccagagtggggaatggttcaaggaaggaatgaaattggaagctatagacccattaaatctttctacaatatgtgtcgcaaccattagaaaggtgctagctgacggattcctgatgattgggatcgatggctcagaagcagcagacggatctgactggttctgttaccatgcaacctctccttctattttccctgtcggtttctgtgaaattaacatgattgaacttactccacccagaggttacacaaaacttccttttaaatggtttgactacctcagggaaactggctccattgcagcaccagtaaaactatttaataaggatgttccaaatcacggatttcgtgtaggaatgaaattagaagcagtagatctcatggagccacgtttaatatgtgtagccacagtaactcgaattattcatcgtctcttgaggatacattttgatggatgggaagaagagtatgatcagtgggtagactgtgagtcacctgacctctatcctgtagggtggtgtcagttaactggatatcaactacagcctccagcatcacagtgtaagttggtatacagaaaaggtgtccttttgtaaaaatcagcaattctccagaggactatctcacataagtcatcttatgagctcacaggacaagaatatacctatgtctgattggttgccagg

SEQ ID NO: 151997 - DNA, 3224 bp, Homo sapiens
  Payload ID: 9924
  Gene Symbol: MBTD1
  Gene Name: mbt domain containing 1
  Uniprot ID: Q05BQ5
  ENST ID: ENST00000405860
  CDS Start-End: 220-729
tcccggggagaggcacctgcccccagcccggggagggggcgccgcgggctcggggagcacggacaacccctacccatgaggccctgatggaaaacacaaaggatctgagtcggaagagacattagaggtcatccaaagcagccgtcccctctgcagcctctctgacaagtgactgaacattcttcacgatctgaaaggaaaagaagagattctttcgggatgtttgacggttatgatagctgcagtgaggacacaagcagcagctccagctccgaagagagtgaggaagaagtcgctcctttaccttctaatctcccgattatcaaaaacaatgggcaagtctacacatacccagatggtaaatctggcatggctacctgtgagatgtgtgggatggttggcgtccgagatgctttttactctaaaacaaagcgtttctgtagcgtttcatgttcaagaagttactcgtcaaactccaagaaggcaagcattttggccagacttcagggtaagcctccaacaaagaaagcaaaagttcttcagaaacaacctttagttgctaagctagccgcatatgctcagtatcaagctaccttgcaaaatcaagcaaagacaaaagcagcagtctccatggaaggtttcagctggggtaactacatcaatagcaatagctttatagcagctccggttacctgttttaaacatggaaggagagtcgctcccagatagccctcacgagtggccctggagcaggaagtggtggagcagatcttccttgtttgggaggagcctgaggtggacctcgcgtcctgagtctggaaggcacctatggggacctgctggggtgatatctcagaaaatgtgagagtagaagttcccaatacagactgcagcctacctaccaaagtcttctggattgctggaattgtaaaattagcaggttacaatgcccttttaagatatgaaggatttgaaaatgactctggtctggacttctggtgcaatatatgtggttctgatatccatccagttggttggtgtgcagccagcggaaaacctcttgttcctcctagaactattcagcataaatatacaaactggaaagcttttctagtgaaacgacttactggtgccaaaacactgcctcctgatttctcccaaaaggtttcagagagtatgcagtatcctttcaaaccttgcatgagagtagaagtggttgacaagaggcatttgtgtcgaacacgagtagcagtggtggaaagtgtaattggaggaagattaagactagtgtatgaagaaagcgaagatagaacagatgacttctggtgccatatgcacagcccattaatacatcatattggttggtctcgaagcataggtcatcgattcaaaagatctgatattacaaagaaacaggatggacattttgatacaccaccacatttatttgctaaggtaaaagaagtagaccagagtggggaatggttcaaggaaggaatgaaattggaagctatagacccattaaatctttctacaatatgtgtcgcaaccattagaaaggtgctagctgacggattcctgatgattgggatcgatggctcagaagcagcagacggatctgactggttctgttaccatgcaacctctccttctattttccctgtcggtttctgtgaaattaacatgattgaacttactccacccagaggttacacaaaacttccttttaaatggtttgactacctcagggaaactggctccattgcagcaccagtaaaactatttaataaggatgttccaaatcacggatttcgtgtaggaatgaaattagaagcagtagatctcatggagccacgtttaatatgtgtagccacagtaactcgaattattcatcgtctcttgaggatacattttgatggatgggaagaagagtatgatcagtgggtagactgtgagtcacctgacctctatcctgtagggtggtgtcagttaactggatatcaactacagcctccagcatcacagtgtaagttggtatacagaaaaggtgtccttttgtaaaaatcagcaattctccagaggactatctcacataagtcatcttatgagctcacaggacaagaatatacctatgtctgattggttgccaggtaagacattaagactcaacaacaatatcacagaatcagaccatgtgtcccatggcaatgtgaatccaatagtcaattacataatgactatagaaacacaacagtcaccaaattaaactagacttactattttagtgagttaaaaattacatactaaaagtttattggtaggtaataaatgcttttgagtaaatagtggaaaatgtctcatgttgaggctatggttttgtaggaacaagtacccttattttcagagcatcatgtacttaagtataatggtcttggtaaagatagttcatataagttgtatctagacaactgtatcgtctaaattgtaaacaattatctagtaccaattttccctttttatttttcagcatcaagagaaaaccaatcagcttcatcaaaacagaagaaaaaggctaagtcccagcaatacaaaggacataagaaaagtgggtcaccacgtggtgttcacatacattttctaattgttaactaattggagtcacagtattcttggacagaaaatgatatatcttgtgagaactgatgattgtgcattatgtattatgcttaaaggtgcagtatgccataaaaggcaaacccttgcaataatgagaaacactgatattttactaacaggagaaattattaccacagtatttaaagtatacgtggtaaagaatagagtctgtgaatgattcttgaaataatatgtaaaacctactgaaagttaatcctttttaaaaactttatttaaaaagaaaaattagcagccaggtgcagtggctcacgcctgtaatcccagcactttaggaggccgaggctggcagatcacaaggtcaggagatcgagaccatcctggctaacacggtgaaaccctgtctccaccaaaaatacaaaaaatctgccgggcgtggtggcacacgcctgaagtcccagctactcaggaggctgaggcaagagaatcacttgaacccaggaggcagaggttgcagtgagccaagatcacgccactacattccagctgggcaacacagcaagactctgtctcaaaaaaaaaaaaaaaaa

SEQ ID NO: 151998 - DNA, 5099 bp, Homo sapiens
  Payload ID: 9924
  Gene Symbol: MBTD1
  Gene Name: mbt domain containing 1
  Uniprot ID: Q05BQ5
  ENST ID: ENST00000415868
  CDS Start-End: 64-1950
tctcttacttcaaagactgaacattcttcacgatctgaaaggaaaagaagagattctttcgggatgtttgacggttatgatagctgcagtgaggacacaagcagcagctccagctccgaagagagtgaggaagaagtcgctcctttaccttctaatctcccgattatcaaaaacaatgggcaagtctacacatacccagatggtaaatctggcatggctacctgtgagatgtgtgggatggttggcgtccgagatgctttttactctaaaacaaagcgtttctgtagcgtttcatgttcaagaagttactcgtcaaactccaagaaggcaagcattttggccagacttcagggtaagcctccaacaaagaaagcaaaagttcttcagaaacaacctttagttgctaagctagccgcatatgctcagtatcaagctaccttgcaaaatcaagcaaagacaaaagcagcagtctccatggaaggtttcagctggggtaactacatcaatagcaatagctttatagcagctccggttacctgttttaaacatgcacctatggggacctgctggggtgatatctcagaaaatgtgagagtagaagttcccaatacagactgcagcctacctaccaaagtcttctggattgctggaattgtaaaattagcaggttacaatgcccttttaagatatgaaggatttgaaaatgactctggtctggacttctggtgcaatatatgtggttctgatatccatccagttggttggtgtgcagccagcggaaaacctcttgttcctcctagaactattcagcataaatatacaaactggaaagcttttctagtgaaacgacttactggtgccaaaacactgcctcctgatttctcccaaaaggtttcagagagtatgcagtatcctttcaaaccttgcatgagagtagaagtggttgacaagaggcatttgtgtcgaacacgagtagcagtggtggaaagtgtaattggaggaagattaagactagtgtatgaagaaagcgaagatagaacagatgacttctggtgccatatgcacagcccattaatacatcatattggttggtctcgaagcataggtcatcgattcaaaagatctgatattacaaagaaacaggatggacattttgatacaccaccacatttatttgctaaggtaaaagaagtagaccagagtggggaatggttcaaggaaggaatgaaattggaagctatagacccattaaatctttctacaatatgtgtcgcaaccattagaaaggtgctagctgacggattcctgatgattgggatcgatggctcagaagcagcagacggatctgactggttctgttaccatgcaacctctccttctattttccctgtcggtttctgtgaaattaacatgattgaacttactccacccagaggttacacaaaacttccttttaaatggtttgactacctcagggaaactggctccattgcagcaccagtaaaactatttaataaggatgttccaaatcacggatttcgtgtaggaatgaaattagaagcagtagatctcatggagccacgtttaatatgtgtagccacagtaactcgaattattcatcgtctcttgaggatacattttgatggatgggaagaagagtatgatcagtgggtagactgtgagtcacctgacctctatcctgtagggtggtgtcagttaactggatatcaactacagcctccagcatcacagtcatcaagagaaaaccaatcagcttcatcaaaacagaagaaaaaggctaagtcccagcaatacaaaggacataagaaaatgacaacactgcagctgaaggaggagttgctggatggagaggattataatttccttcaaggagcgtctgatcaggaaagcaatggctctgccaacttctacatcaaacaagagccatgaggtggcttagaaactgagggcgggtggggaaggattttacacaggactgatttataatcaatccagctgtacagggggctactctactgggacattttgctaaacatagaagatttcagttccagatttttcaggtgggtgggggagctattttagtcgggggggcaggggggtgggaaattttcaatttataaagatggacaatttttgtgttgtatttgaagcttttgaaagaattttgtaatattttccaagtttggatttatgtgcattgttaacaagaactgaaattctaacttttttggtaacattaaagtttaggtagcaggattgaaggaaatgatttaagaaggatatagctgttaaatgcaaatgaactgtcattacaaatgaacctttttggtacctgttgggagattttgggatttttagaagttaggccagtcacatctccagcttcttttgctgcagaaatatgcaactgaactcctcatggaggggtcatcaccacaaaggtcatggaagggtcattatttctcttgttggcattttattgcagcccattttaaatgtttgtacagaaatatttttcattctgtgaaaatttatttggagttctgtatgaaactggaagaactctggatacttttatatgttctcttttaattaaaaaaatgattagaattatcctaacactaaagtgttaaactggaatggttgacaagatattcaggatctcagtctacacattgaggggttggggaaaatgtaatgttgtccttagtttattttcctttctaaaaaaaataccccacgaaagggattctgatcagttctctgccatttccctctatctgtgaaataacagcttcgtataaccacaaccaaaaacagatgttctgtattaggagaatcgaattgaaagttattcaaagccaaaataagtttagatttcaaaatcattccagctctgcttttatctatcctggatttggtagaaaactaatttgaaagagaatttaattttcttaaaattccatatatatatatatatatatatatatatatatatatatatatatatatatataaaattgtctttaattgtattcaggatttattttaataataaccgatttggaccattttgaacattccctgttttaaaattcatatgacttccttttaaaaaaaaaaaaaggatacaagggtaaactggtgaaaggtttgctctctgcattttctaactttctactgagttgtgactgaatgagagcgctctagcgtttaccagtgaggttcataaactaaactctcaggaattaattgcatctgttctagaagtgcttctgggtcttagcctggcctcttcagagtggtaatattgaccatctcctctggaatataggtagggctaattagaaattaatcaaaatgattaacctctacagtccttcagcctatggaatgctttaaaaaatgttaatggaaagccccaggagaccattttaggtaagacttttgtttgaattttaaaatgcatagaacgttaaaaaaaaccagcaatttattttctaaaatattgctctacttttgggaataatagcattggtaatacgcacaggtttacctcattctatgcaagaggggttaataacataaggttttataatagctactggaagtaaaatttgttactttatagtgtaagaatgtatggaatcgcatgtcaccatttcttaatactgactctttaggggcataaatgcagatcacatcaacgcaagttgattctcatgtgtcaaatatatgtgaattcagctgttaaattactggatatttatcttaacattgctgagagggacctactgtaaatgtgacatcctcacacttcccatatctttaactttgaaaaatcttcttgtaaacttaaagcctagaagtattccaaagcaagggttagagcagtctttattctcaggctcactgaattaaacccaggactaattccacagcacaggcacaagaagcctgttgtgtagtgtactctgccagtaccttggatttaggagctccatggggaactgactaaaccaggagagagaggatttggagctagtcagtcctggtaatctatgaaatgctcatttatacccaggtttcataagcttccaattctatagcaaacccaggctctgagtgttttagaatttcctaattcatgaagtgtttcttgtcttgatcccgtgaccaacagttgaaggttggtaaggacttttctacagtctgaacacaacctaaagccctctttcattgttcacacactaactcctactgccgacgaaccgaaaaataattaatgcagaggagatttatgtcttagccataactccagttgtacaactcaatcgccccattctcttttacggttcaaaatgtactgctgaccttgggtttgtttttgttttgttttgtttttcctgttaggatttatttggggacttttggtagtttaaactctttaaccttttccttgccgtgtatgaggaaagctaaagctgttatcaacttcttattctacgatactaacacgggttttcagtgtttgtttgtttttattattattattaattttgcgtgatgtgaataccctctcccatcaatatttgtattatggtgctatatattggtaatgatcctttaatattgggaagggattttaaaaatactgtgattaaactgggtttcttcctttgattttcatattttaaataaagccacagtcatttatacaaaagaaaagcatctgtccctgggcaaatcttttgaggacagaggtcaaagtaaactgcataaggtttttacatcatttctgtatgtatttgatatatagatcaatatctgtacaaatttaatcttttattttcttggtaactcgtgatcattgagaaagtgtttgaaactttctcatgaagtgtatatataatggcgtgaaaaattcctttggaaaaatttatgttcctttcatttttaccaaattgcaaattttcagcatggatgtgaaaagcattaaaattataactttgtgtacaagatgaaaataattcactaaatttgcccttttttacacaaaataaaatgttaaagtt

SEQ ID NO: 151999 - DNA, 534 bp, Homo sapiens
  Payload ID: 9924
  Gene Symbol: MBTD1
  Gene Name: mbt domain containing 1
  ENST ID: ENST00000586898
  CDS Start-End: 1-270
gatgttccaaatcacggatttcgtgtaggaatgaaattagaagcagtagatctcatggagccacgtttaatatgtgtagccacagtaactcgaattattcatcgtctcttgaggatacattttgatggatgggaagaagagtatgatcagtgggtagactgtgagtcacctgacctctatcctgtagggtggtgtcagttaactggatatcaactacagcctccagcatcacagtgtaagttggtatacagaaaaggtgtccttttgtaaaaatcagcaattctccagaggactatctcacataagtcatcttatgagctcacaggacaagaatatacctatgtctgattggttgccagcatcaagagaaaaccaatcagcttcatcaaaacagaagaaaaaggctaagtcccagcaatacaaaggacataagaaaagtgggtcaccacgtggtgttcacatacattttctaattgttaactaattggagtcacagtattcttggacagaaaatgatatatcttgtgagaactg

SEQ ID NO: 152000 - DNA, 5382 bp, Homo sapiens
  Payload ID: 9924
  Gene Symbol: MBTD1
  Gene Name: mbt domain containing 1
  Uniprot ID: Q05BQ5
  ENST ID: ENST00000586178
  CDS Start-End: 345-2231
ggagggagggctatgctaatgttgttgatatcctggggccacccgagttaaaggggggaaatccgggggctgctgcacccgccaccggtctgggcccagccgggggccccctgtagtcgccgcagtcccggggagaggcacctgcccccagcccggggagggggcgccgcgggctcggggagcacggacaacccctacccatgaggccctgatggaaaacacaaaggatctgagtcggaagagacattagaggtcatccaaagcagccgtcccctctgcagcctctctgacaagtgactgaacattcttcacgatctgaaaggaaaagaagagattctttcgggatgtttgacggttatgatagctgcagtgaggacacaagcagcagctccagctccgaagagagtgaggaagaagtcgctcctttaccttctaatctcccgattatcaaaaacaatgggcaagtctacacatacccagatggtaaatctggcatggctacctgtgagatgtgtgggatggttggcgtccgagatgctttttactctaaaacaaagcgtttctgtagcgtttcatgttcaagaagttactcgtcaaactccaagaaggcaagcattttggccagacttcagggtaagcctccaacaaagaaagcaaaagttcttcagaaacaacctttagttgctaagctagccgcatatgctcagtatcaagctaccttgcaaaatcaagcaaagacaaaagcagcagtctccatggaaggtttcagctggggtaactacatcaatagcaatagctttatagcagctccggttacctgttttaaacatgcacctatggggacctgctggggtgatatctcagaaaatgtgagagtagaagttcccaatacagactgcagcctacctaccaaagtcttctggattgctggaattgtaaaattagcaggttacaatgcccttttaagatatgaaggatttgaaaatgactctggtctggacttctggtgcaatatatgtggttctgatatccatccagttggttggtgtgcagccagcggaaaacctcttgttcctcctagaactattcagcataaatatacaaactggaaagcttttctagtgaaacgacttactggtgccaaaacactgcctcctgatttctcccaaaaggtttcagagagtatgcagtatcctttcaaaccttgcatgagagtagaagtggttgacaagaggcatttgtgtcgaacacgagtagcagtggtggaaagtgtaattggaggaagattaagactagtgtatgaagaaagcgaagatagaacagatgacttctggtgccatatgcacagcccattaatacatcatattggttggtctcgaagcataggtcatcgattcaaaagatctgatattacaaagaaacaggatggacattttgatacaccaccacatttatttgctaaggtaaaagaagtagaccagagtggggaatggttcaaggaaggaatgaaattggaagctatagacccattaaatctttctacaatatgtgtcgcaaccattagaaaggtgctagctgacggattcctgatgattgggatcgatggctcagaagcagcagacggatctgactggttctgttaccatgcaacctctccttctattttccctgtcggtttctgtgaaattaacatgattgaacttactccacccagaggttacacaaaacttccttttaaatggtttgactacctcagggaaactggctccattgcagcaccagtaaaactatttaataaggatgttccaaatcacggatttcgtgtaggaatgaaattagaagcagtagatctcatggagccacgtttaatatgtgtagccacagtaactcgaattattcatcgtctcttgaggatacattttgatggatgggaagaagagtatgatcagtgggtagactgtgagtcacctgacctctatcctgtagggtggtgtcagttaactggatatcaactacagcctccagcatcacagtcatcaagagaaaaccaatcagcttcatcaaaacagaagaaaaaggctaagtcccagcaatacaaaggacataagaaaatgacaacactgcagctgaaggaggagttgctggatggagaggattataatttccttcaaggagcgtctgatcaggaaagcaatggctctgccaacttctacatcaaacaagagccatgaggtggcttagaaactgagggcgggtggggaaggattttacacaggactgatttataatcaatccagctgtacagggggctactctactgggacattttgctaaacatagaagatttcagttccagatttttcaggtgggtgggggagctattttagtcgggggggcaggggggtgggaaattttcaatttataaagatggacaatttttgtgttgtatttgaagcttttgaaagaattttgtaatattttccaagtttggatttatgtgcattgttaacaagaactgaaattctaacttttttggtaacattaaagtttaggtagcaggattgaaggaaatgatttaagaaggatatagctgttaaatgcaaatgaactgtcattacaaatgaacctttttggtacctgttgggagattttgggatttttagaagttaggccagtcacatctccagcttcttttgctgcagaaatatgcaactgaactcctcatggaggggtcatcaccacaaaggtcatggaagggtcattatttctcttgttggcattttattgcagcccattttaaatgtttgtacagaaatatttttcattctgtgaaaatttatttggagttctgtatgaaactggaagaactctggatacttttatatgttctcttttaattaaaaaaatgattagaattatcctaacactaaagtgttaaactggaatggttgacaagatattcaggatctcagtctacacattgaggggttggggaaaatgtaatgttgtccttagtttattttcctttctaaaaaaaataccccacgaaagggattctgatcagttctctgccatttccctctatctgtgaaataacagcttcgtataaccacaaccaaaaacagatgttctgtattaggagaatcgaattgaaagttattcaaagccaaaataagtttagatttcaaaatcattccagctctgcttttatctatcctggatttggtagaaaactaatttgaaagagaatttaattttcttaaaattccatatatatatatatatatatatatatatatatatatatatatatatatatataaaattgtctttaattgtattcaggatttattttaataataaccgatttggaccattttgaacattccctgttttaaaattcatatgacttccttttaaaaaaaaaaaaaggatacaagggtaaactggtgaaaggtttgctctctgcattttctaactttctactgagttgtgactgaatgagagcgctctagcgtttaccagtgaggttcataaactaaactctcaggaattaattgcatctgttctagaagtgcttctgggtcttagcctggcctcttcagagtggtaatattgaccatctcctctggaatataggtagggctaattagaaattaatcaaaatgattaacctctacagtccttcagcctatggaatgctttaaaaaatgttaatggaaagccccaggagaccattttaggtaagacttttgtttgaattttaaaatgcatagaacgttaaaaaaaaccagcaatttattttctaaaatattgctctacttttgggaataatagcattggtaatacgcacaggtttacctcattctatgcaagaggggttaataacataaggttttataatagctactggaagtaaaatttgttactttatagtgtaagaatgtatggaatcgcatgtcaccatttcttaatactgactctttaggggcataaatgcagatcacatcaacgcaagttgattctcatgtgtcaaatatatgtgaattcagctgttaaattactggatatttatcttaacattgctgagagggacctactgtaaatgtgacatcctcacacttcccatatctttaactttgaaaaatcttcttgtaaacttaaagcctagaagtattccaaagcaagggttagagcagtctttattctcaggctcactgaattaaacccaggactaattccacagcacaggcacaagaagcctgttgtgtagtgtactctgccagtaccttggatttaggagctccatggggaactgactaaaccaggagagagaggatttggagctagtcagtcctggtaatctatgaaatgctcatttatacccaggtttcataagcttccaattctatagcaaacccaggctctgagtgttttagaatttcctaattcatgaagtgtttcttgtcttgatcccgtgaccaacagttgaaggttggtaaggacttttctacagtctgaacacaacctaaagccctctttcattgttcacacactaactcctactgccgacgaaccgaaaaataattaatgcagaggagatttatgtcttagccataactccagttgtacaactcaatcgccccattctcttttacggttcaaaatgtactgctgaccttgggtttgtttttgttttgttttgtttttcctgttaggatttatttggggacttttggtagtttaaactctttaaccttttccttgccgtgtatgaggaaagctaaagctgttatcaacttcttattctacgatactaacacgggttttcagtgtttgtttgtttttattattattattaattttgcgtgatgtgaataccctctcccatcaatatttgtattatggtgctatatattggtaatgatcctttaatattgggaagggattttaaaaatactgtgattaaactgggtttcttcctttgattttcatattttaaataaagccacagtcatttatacaaaagaaaagcatctgtccctgggcaaatcttttgaggacagaggtcaaagtaaactgcataaggtttttacatcatttctgtatgtatttgatatatagatcaatatctgtacaaatttaatcttttattttcttggtaactcgtgatcattgagaaagtgtttgaaactttctcatgaagtgtatatataatggcgtgaaaaattcctttggaaaaatttatgttcctttcatttttaccaaattgcaaattttcagcatggatgtgaaaagcattaaaattataactttgtgtacaagatgaaaataattcactaaatttgcccttttttacacaaaataaaatgttaaagttaa

SEQ ID NO: 152001 - DNA, 2826 bp, Homo sapiens
  Payload ID: 9925
  Gene Symbol: MCF2
  Gene Name: MCF.2 cell line derived transforming sequence
  Uniprot ID: P10911
  ENST ID: ENST00000338585
  CDS Start-End: 1-2826
atggcagaagcaaatccccggagaggcaagatgaggttcagaaggaatgcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagtgggagttggatactctttctttcaagcatgtaaacttttttcaaaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattga

SEQ ID NO: 152002 - DNA, 2583 bp, Homo sapiens
  Payload ID: 9925
  Gene Symbol: MCF2
  Gene Name: MCF.2 cell line derived transforming sequence
  Uniprot ID: P10911
  ENST ID: ENST00000370573
  CDS Start-End: 1-2583
atggcagaagcaaatccccggagaggcaagatgaggttcagaaggaatgcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaagacctgtgtcggagatggctctcctatattgatgaagctactatgtcaaatggcaagtag

SEQ ID NO: 152003 - DNA, 3688 bp, Homo sapiens
  Payload ID: 9925
  Gene Symbol: MCF2
  Gene Name: MCF.2 cell line derived transforming sequence
  Uniprot ID: P10911
  ENST ID: ENST00000370576
  CDS Start-End: 211-2988
gatctgtcagctgactaatcagggatagtggtttttttttttttttcctccccagcattgctgccactgtgctaatggaagcagccacggcagctttgtttgatagagatttttggctgccgtttttaaatactacccaagaagcagctcgtatttcatcaacgttgcgttgacaattggaaaagaaaagtgtaattgcgtacaggcgaaatggcagaagcaaatccccggagaggcaagatgaggttcagaaggaatgcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggtt

SEQ ID NO: 152004 - DNA, 3813 bp, Homo sapiens
  Payload ID: 9925
  Gene Symbol: MCF2
  Gene Name: MCF.2 cell line derived transforming sequence
  Uniprot ID: P10911
  ENST ID: ENST00000414978
  CDS Start-End: 156-3113
catgttaagagcaagaaggcttttgttcttggagcaggcagagagtattgtacattcttttggccgaggaaacagaatgagctgcgacagtcttaaggacaaacatttgtgaaaccgatctgctcctccgtataaaggacatcagtcatttcttaatgcaagacatcgccttcttgtctggtggccggggaaaggacaatgcttggatcattacgtttccagaaaactgtaattttagatgtataccagaggaagtaatagcaaaagtacttacttacctgacatctattgcaaggcaaaatggatcagactcccggtttaccattattctggatcgaagattggatacatggtcttctctcaaaatctctctccaaaaaatctcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggtt

SEQ ID NO: 152005 - DNA, 1988 bp, Homo sapiens
  Payload ID: 9925
  Gene Symbol: MCF2
  Gene Name: MCF.2 cell line derived transforming sequence
  ENST ID: ENST00000437564
  CDS Start-End: 1-1288
ccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggtt

SEQ ID NO: 152006 - DNA, 1916 bp, Homo sapiens
  Payload ID: 9925
  Gene Symbol: MCF2
  Gene Name: MCF.2 cell line derived transforming sequence
  ENST ID: ENST00000446225
  CDS Start-End: 1-1587
gttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttat

SEQ ID NO: 152007 - DNA, 3945 bp, Homo sapiens
  Payload ID: 9925
  Gene Symbol: MCF2
  Gene Name: MCF.2 cell line derived transforming sequence
  Uniprot ID: P10911
  ENST ID: ENST00000520602
  CDS Start-End: 287-3244
cctgggttcgccaaggcgggcggccaggcacatgccccaagctgccgcttcggcgccgtggacctcagtgtcctgcggcaggatcccaggcctgccccagaacccagatggctgcactttcatgccgatagcccaggcgatccctctgcaggtggacatggccatggccctgcagcgcgtgaggattgccgagaagtacgggaagaactacctctgcctcctgcaagcagtcttcgtggcagaaaccgatctgctcctccgtataaaggacatcagtcatttcttaatgcaagacatcgccttcttgtctggtggccggggaaaggacaatgcttggatcattacgtttccagaaaactgtaattttagatgtataccagaggaagtaatagcaaaagtacttacttacctgacatctattgcaaggcaaaatggatcagactcccggtttaccattattctggatcgaagattggatacatggtcttctctcaaaatctctctccaaaaaatctcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggtta

SEQ ID NO: 152008 - DNA, 3346 bp, Homo sapiens
  Payload ID: 9925
  Gene Symbol: MCF2
  Gene Name: MCF.2 cell line derived transforming sequence
  Uniprot ID: P10911
  ENST ID: ENST00000519895
  CDS Start-End: 167-3172
aaactttttttcatgttaagagcaagaaggcttttgttcttggagcaggcagagagtattgtacattcttttggccgaggaaacagaatgagctgcgacagtcttaaggacaaacatttgtgaaaccgatctgctcctccgtataaaggacatcagtcatttcttaatgcaagacatcgccttcttgtctggtggccggggaaaggacaatgcttggatcattacgtttccagaaaactgtaattttagatgtataccagaggaagtaatagcaaaagtacttacttacctgacatctattgcaaggcaaaatggatcagactcccggtttaccattattctggatcgaagattggatacatggtcttctctcaaaatctctctccaaaaaatctcggcttccttccctgggaacttgcacttggttttggttttacgtcctaccagctttcttcaacgaacgttcacagacattggattttggtttagtcaggaggattttatgcttaaattaccagttgttatgctgagctcagttagtgatttgctgacatacattgatgacaagcaattaacccctgagttaggcggcaccttgcagtactgccacagtgaatggatcatcttcagaaatgctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagtgggagttggatactctttctttcaagcatgtaaacttttttcaaaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaaaagcaacagggagcttttataagtactgaggaaactgaattggaacacaccagcactgtggtggaggtctgtgaggcaattgcgtcagttcaggcagaagcaaatacagtttggactgaggcatcacaatctgcagaaatctctgaagaacctgcggaatggtcaagcaactatttctaccctacttatgatgaaaatgaagaagaaaataggcccctcatgagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagctttt

SEQ ID NO: 152009 - DNA, 3461 bp, Homo sapiens
  Payload ID: 9925
  Gene Symbol: MCF2
  Gene Name: MCF.2 cell line derived transforming sequence
  Uniprot ID: P10911
  ENST ID: ENST00000536274
  CDS Start-End: 324-2789
aggacatgcctgatcttcttgagcagtccagcacaagctaatccacaaggttcaatcaggctaagtaattggaggaatgtgttaactctgaattacaaggagcagaagggaaggatctgtcagctgactaatcagggatagtggtttttttttttttttcctccccagcattgctgccactgtgctaatggaagcagccacggcagctttgtttgatagagatttttggctgccgtttttaaatactacccaagaagcagctcgtatttcatcaacgttgcgttgacaattggaaaagaaaagtgtaattgcgtacaggcgaaatggcagaagcaaatccccggagaggcaagatgaggttcagaaggaatgcggcttccttccctgggaacttgcacttggttttggttttacgtcctaccagctttcttcaacgaacgttcacagacattggattttggtttagtcaggaggattttatgcttaaattaccagctatagaaaattttgccctcacagtgaaagaaatggctcagatgttacagtcctttggaactgaactggctgagacagaactaccagatgatattccctcaatagaagaaattctggcaattcgtgctgaaaggtatcatctgttgaagaatgatattacagctgtaaccaaagaaggaaaaattctgctaacaaatctggaagtgcctgacactgaaggagctgtcagttcaagactagaatgtcatcggcaaataagtggtgactggcaaactattaataagttgctgactcaagtacatgatatggaaacagcttttgatggattttgggaaaaacatcaattaaaaatggagcagtatctgcaactatggaagtttgagcaggattttcaacagcttgtgactgaagttgaatttctattaaaccaacaagcagaactggctgatgtaacagggactatagctcaagtaaaacaaaaaataaaaaaattggaaaacttagatgaaaattctcaggagctattatcaaaggcccagtttgtgatattacatggacacaagcttgcagcaaatcaccattatgcacttgatttaatctgccagaggtgcaatgagctacgttacctttctgatattttggttaatgagataaaagcaaaacggatacaactcagcaggaccttcaaaatgcataaactcctacagcaggctcgtcaatgctgtgatgaaggggaatgtcttctagctaatcaggaaatagataagtttcagtctaaagaagatgctcagaaagctctccaagacattgaaaattttcttgaaatggctctaccctttataaattatgaacctgaaacactgcagtatgaatttgatgtaatattatctcctgagcttaaggttcaaatgaagactatacaactcaagcttgaaaacattcgaagtatatttgagaaccagcaggctggtttcaggaacctggcagataagcatgtgaggccaatccaatttgtggtacccacacctgaaaatttggtcacatctgggacaccatttttttcatctaaacaagggaagaagacttggagacaaaatcagagcaacttaaaaattgaagtggtgcctgattgtcaggagaagagaagttctggtccatcctccagtttggacaatggcaatagcttggatgttttaaagaaccacgtactaaatgaactgatacagactgagagagtttatgttcgagaactgtatactgttttgttgggttatagagcggagatggataatccagagatgtttgatcttatgccacctctcctgagaaataaaaaggacattctctttggaaacatggcagaaatatatgaattccataacgacattttcttgagcagcctggaaaattgtgctcatgctccagaaagagtgggaccttgtttcctggaaaggaaggatgattttcagatgtatgcaaaatattgtcagaataagcccagatcagaaacaatttggaggaagtattcagaatgcgcatttttccaggaatgtcaaagaaagttaaaacacagacttagactggattcctatttactcaaaccagtgcaacgaatcactaaatatcagttattgttgaaggagctattaaaatatagcaaagactgtgaaggatctgctctgttgaagaaggcactcgatgcaatgctggatttactgaagtcagttaatgattctatgcatcagattgcaataaatggctatattggaaacttaaatgaactgggcaagatgataatgcaaggtggattcagcgtttggatagggcacaagaaaggtgctacaaaaatgaaggatttggctagattcaaaccaatgcagcgacaccttttcttgtatgaaaaagccattgttttttgcaaaaggcgtgttgaaagtggagaaggctctgacagatacccgtcatacagttttaaacactgttggaaaatggatgaagttggaatcactgaatatgtaaaaggtgataaccgcaagtttgaaatctggtatggtgaaaaggaagaagtttatattgtccaggcttctaatgtagatgtgaagatgacgtggctaaaagaaataagaaatattttgttgaagcagcaggaacttttgacagttaaaaaaagaaagcaacaggatcaattaacagaacgggataagtttcagatttctcttcagcagaatgatgaagacctgtgtcggagatggctctcctatattgatgaagctactatgtcaaatggcaagtagctctttcctgcctgcttctcagctcatttggaaaaatactgcgcaaaagacattgagctcaaatgatgcagatgttgttttcaggttaatggacacgcaaagaaaccacagcacatacttcttttctttcatttaataaagcttttaattatggtacgctgtctttttaaaatcatgtatttaatgtgtcagatattgtgcttgaaagattctcatctcagaatacttttggacttgaaaattatttcttctctactttgtaaccaaatgcaatcggtgtgccttggattatttagtttattaatgaattaagtcaaaattacggctgcaaaatggctaaggtcaagtaaagcacaacattatgatttaatatgcttttgttgaaaccacagcttttgtgcccattgttttaacttgtgtgaaacaatacaaagcccagaaattcttttcggggcatgagtaaattttgttcagggctactgtctgtatgtgcccagataaaattttcatgagagtagtttacaaaagccgtatttaaaagttaatattttcacactttttttctggatttctgcttataattaatgtaacttaaattagttgtgctctgctattttctgtatatttcatgttgtaattctttttttcaaataaaaattaattcttcaggtt

SEQ ID NO: 152010 - DNA, 2419 bp, Homo sapiens
  Payload ID: 9926
  Gene Symbol: MCF2L
  Gene Name: MCF.2 cell line derived transforming sequence-like
  ENST ID: ENST00000261963
  CDS Start-End: 1-890
ggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcg

SEQ ID NO: 152011 - DNA, 3413 bp, Homo sapiens
  Payload ID: 9926
  Gene Symbol: MCF2L
  Gene Name: MCF.2 cell line derived transforming sequence-like
  Uniprot ID: O15068
  ENST ID: ENST00000375597
  CDS Start-End: 158-3112
ggctgccctgcagaggccaggtctgcccagcaaacccaggaaggtgtggcgtccccgcttcgcggccaagatggtgctggtgctgcgccatcctttgtgtgcccgggaagggcgttccgggagccgggtcgggggctcctgactcgcactgggcagcatgacggtgcgccggctgtcactgctgtgccgggacctctgggcgctgtggctgctgctgaaggccggcgcagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaagagccctaggaccccacagaagagcccctccctctccattgctctgcacccctgcatcagcaaggccagccccagaaggagcctcggccgagcgtgcaacccggagccgccttgggccctccctgcgacagccggacccgcctccgcatcgggttgcgatgccctctgcatagtttctttctcttccttcatagatgacacggtcactagctctgcctcagaaagctctgcgctttccagaaagcgctttaccctgcagggttttgctaacctcaaaggtcagaaaggtaaaagtagtgcctgccccaaa

SEQ ID NO: 152012 - DNA, 6445 bp, Homo sapiens
  Payload ID: 9926
  Gene Symbol: MCF2L
  Gene Name: MCF.2 cell line derived transforming sequence-like
  Uniprot ID: O15068
  ENST ID: ENST00000375604
  CDS Start-End: 198-3569
agggacatcgaatcggaggccctgggaggagcagccggctggctgccctgcagaggccaggtctgcccagcaaacccaggaaggtgtggcgtccccgcttcgcggccaagatggtgctggtgctgcgccatcctttgtgtgcccgggaagggcgttccgggagccgggtcgggggctcctgactcgcactgggcagcatgacggtgcgccggctgtcactgctgtgccgggacctctgggcgctgtggctgctgctgaaggccggcgcagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgccatctgcctttgtctgtcaagacacagaacgtctcagcagtcggggtttccagggccgcagtgcactgtgcttgcacatggtaagtcattgttgggacggaaaagaagccggcagtgggcagggcccagcgtgcggctcaggcaccgagcaaccgctttgctttcttctgtcagacggcgatgatgacaaaatagcaacaaggttgtgcgtgtcagaaacgcaaaggcagcagaggaagcgtagtggaaccattacagaatcacaatgcagccgacactctccagaccagaaaagggagcataaagaaagggtattgatccaatagaagaagggaagggtggagaaaggggaaagcatggttaacaggaaacaacatgtaacggaagagacagcccagatgtgtctggctcacaacagacgtgatcatgttatgctggcctggaagagcatcggatcagacgtgacaagtcactgcttagagaccatcaagcaaatttatatatagattggagatttaaaataaaagaagacagaacagacaaacaccataagaaagctggtgtagcagtatcgatgacctgaaatgggattcaggacagttcatagagtaaagggggctgcgtggcaatcaggaactcataagccactgactataaagctcaaaacacagcaaagttggcagtcggcagacagcaatgttgactgtcatgaaaagtgatccctgtttgcccctaaacgtagagaaatctgcgttattttccagcacacatggagcacaaacaaaatatttgcaaaacaatgggaagatcattgaaacactgtttggcaatttaaaagcttgtttctaactcacgggatgcgggcagtctgctctctagaactggacagcgtgcacagagccacgggagggagcagccacggccagctcagattggtgtcgacagcttagtggtgtctgattttatacatgacaaaatgaacgagttaaccatttaagccaaaaaaataagactagcgtaacccaaagaaagtatttaaatacttctgtcaattaggacagttgagaaaagagaataacaaaatcaaaagcaaaactcaaactttgtacctgaaaaatctaataaaactgactaatttatagaaaacctaagaaactccatatcaaataaaaaattttaaatatgag

SEQ ID NO: 152013 - DNA, 3648 bp, Homo sapiens
  Payload ID: 9926
  Gene Symbol: MCF2L
  Gene Name: MCF.2 cell line derived transforming sequence-like
  Uniprot ID: O15068
  ENST ID: ENST00000375608
  CDS Start-End: 59-3472
acctgcggggcgcggagctcggcggacgcgggagggcagcaccacgggcggcagcctcatgtttgactgttggagatttatcctgtgcaagagacctggaagcaacagttattcttccccacaacggcccaatgaggccaaaaaggaggaaacggatcaccaaattgatgtgtctgacgtcatcaggcttgttcaagacacaccggaggcgacggccatggccacagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcg

SEQ ID NO: 152014 - DNA, 3903 bp, Homo sapiens
  Payload ID: 9926
  Gene Symbol: MCF2L
  Gene Name: MCF.2 cell line derived transforming sequence-like
  ENST ID: ENST00000397017
  CDS Start-End: 1-2380
gtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaagcttctcctaccagtcctgacaaaaaagccaagcggcatgaagtaaagagcgacccgactccctttggtgtgcgaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccc

SEQ ID NO: 152015 - DNA, 576 bp, Homo sapiens
  Payload ID: 9926
  Gene Symbol: MCF2L
  Gene Name: MCF.2 cell line derived transforming sequence-like
  ENST ID: ENST00000397021
  CDS Start-End: 64-324
accaggctcatccgaggacggaggctgtcgttatacaacgcgcaagtgtggtctctgtcacagatgtggctgtcgcagagagtgctgcctcctctcccgtttccagcagatgcttgggaaccttcagaagtcttggggattttctcccagcaccgtagccatgccaccacgagtgaatccttaacgtggaccagcacgggcacctcagatgccaggaccggcgtgatcctgcaggacgctggcatcggattcatcctggtgatagaccggcgacgggacaaatggacctccgtgaaggcgtccgtcctgcgcatcgcaaattagaggccccatatctgctccgatgcccacaaccttcatcgttttggtgcaagcctgtccctgagccgctggttctcatcgaagtctttaggatgaggcatctccttgcacccccacggcacctctctgcccctcgccgcggcggatccccgttcctgaccctgactcaacctggcacacaccacctatggcatcgttatctgaaataattcaaaacgcttcaggatgcttccaaaaaagtagacgtgtatagaa

SEQ ID NO: 152016 - DNA, 490 bp, Homo sapiens
  Payload ID: 9926
  Gene Symbol: MCF2L
  Gene Name: MCF.2 cell line derived transforming sequence-like
  ENST ID: ENST00000397024
  CDS Start-End: 19-429
tgactcgcactgggcagcatgacggtgcgccggctgtcactgctgtgccgggacctctgggcgctgtggctgctgctgaaggccggcgcagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcggcgggcaggagagcagcatcaggccggtgagctgcaggctgacttgggaggggtgccgcgggggtctctcatctgatgtgctcgtcccagcctccaggaagatgctgagaatgtcagcctcacaccagacagtgtagttgctgcttccatttggggtatagtgaacacacaccaagtaaaaacagaaatatccttaaa

SEQ ID NO: 152017 - DNA, 6580 bp, Homo sapiens
  Payload ID: 9926
  Gene Symbol: MCF2L
  Gene Name: MCF.2 cell line derived transforming sequence-like
  Uniprot ID: O15068
  ENST ID: ENST00000397030
  CDS Start-End: 38-3328
cgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtaagaccccgcgctcagccccggactgccccgcacgtggctgccgctgaccctcgccccttgcaggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgccatctgcctttgtctgtcaagacacagaacgtctcagcagtcggggtttccagggccgcagtgcactgtgcttgcacatggtaagtcattgttgggacggaaaagaagccggcagtgggcagggcccagcgtgcggctcaggcaccgagcaaccgctttgctttcttctgtcagacggcgatgatgacaaaatagcaacaaggttgtgcgtgtcagaaacgcaaaggcagcagaggaagcgtagtggaaccattacagaatcacaatgcagccgacactctccagaccagaaaagggagcataaagaaagggtattgatccaatagaagaagggaagggtggagaaaggggaaagcatggttaacaggaaacaacatgtaacggaagagacagcccagatgtgtctggctcacaacagacgtgatcatgttatgctggcctggaagagcatcggatcagacgtgacaagtcactgcttagagaccatcaagcaaatttatatatagattggagatttaaaataaaagaagacagaacagacaaacaccataagaaagctggtgtagcagtatcgatgacctgaaatgggattcaggacagttcatagagtaaagggggctgcgtggcaatcaggaactcataagccactgactataaagctcaaaacacagcaaagttggcagtcggcagacagcaatgttgactgtcatgaaaagtgatccctgtttgcccctaaacgtagagaaatctgcgttattttccagcacacatggagcacaaacaaaatatttgcaaaacaatgggaagatcattgaaacactgtttggcaatttaaaagcttgtttctaactcacgggatgcgggcagtctgctctctagaactggacagcgtgcacagagccacgggagggagcagccacggccagctcagattggtgtcgacagcttagtggtgtctgattttatacatgacaaaatgaacgagttaaccatttaagccaaaaaaataagactagcgtaacccaaagaaagtatttaaatacttctgtcaattaggacagttgagaaaagagaataacaaaatcaaaagcaaaactcaaactttgtacctgaaaaatctaataaaactgactaatttatagaaaacctaagaaactccatatcaaataaaaaattttaaatatgagagaa

SEQ ID NO: 152018 - DNA, 1544 bp, Homo sapiens
  Payload ID: 9926
  Gene Symbol: MCF2L
  Gene Name: MCF.2 cell line derived transforming sequence-like
  ENST ID: ENST00000397036
  CDS Start-End: 9-203
gcagcctcatgtttgactgttggagatttatcctgtgcaagagacctggaagcaacagttattcttccccacaacggcccaatgaggccaaaaaggaggaaacggatcaccaaattgatgtgtctgacgtcatcaggcttgttcaagacacaccggaggcgacggccatggccacagaggtctcggcatctcgtccacagtgagctggtgtcctgccagtctcgggaggcactcggcagtgtgagtacatccttcacctctgtgtctacagacccggcctccccgcccagcatgggttgaagccaggctaaggcgttgatcccaaggggctgtctgcaggggtttggggcaggcctgagcattcaccccagcgtcctgtgcaaacgtcttcgtcaggagcgcacttgggaagtcctacactagcgcagagggtgcgcagccagcgggtctatcaacttggatgcaggtagtgctcagtggcatttggaggagagtctaataaccaagaggatgaatctctttgaaggatctgatggaaacaagaaatgaagagggttgttttgttttgtttgttttatgagacagagtcctgctctgttgcccaagctggatggagtgcagtggtgcaatctcagctccttgcggccgccgcctcctgggttccagctattctcctgcctcagcctcccaagtagctgggattacaggcatgcactttgacaccccggctaatttttgtatttttagtagagatggggtttcaccatgttgtccaggctggtctcaagctcttgacctcaagtgatccgcccgccttggcctcccaaagtgctgggattacaggcatgagccactgtgcctggccacgaaatgaagagattttactacctgaaccttaaaactgttcctgagaaatcaccaagaagactgaccagcaaatgaaaacctggaaaaaaattgcaacaaaggatagatatttatctatgcatctgtcttacatagcagagtgaaaaggaggcacacgttcatagaaagtgaatataaagcttgcacagaaataggctgacctgttcagtttaaagaaatgtaatgctgaccacaaggtctctttctctttccatttttatggccaaaaattccaagcctgctggtaggaatgccagtccttatcgatatactggaaaacaactgatgtcagtaaaagtcttcaaatatttttagttttcgtcagcaatgttcacttctaagaatttaaaagaagaaaatgataaaaatattgtcacaaacattcatgaacaaaggtgatcatcacagccgttatttataattatgaacacttgcaggaaagcaaaattacagcagtaagggtttggaaatgatttagttgttgagatcataattctccctggcacatcttacactataataagtgaaattgccagttataaaaacgatacacagtcttcaattttgtaaacaccaaatatgtgcagttttgtaaaagacttaagatatgcacctaaatataaatgtttttaatcata

SEQ ID NO: 152019 - DNA, 574 bp, Homo sapiens
  Payload ID: 9926
  Gene Symbol: MCF2L
  Gene Name: MCF.2 cell line derived transforming sequence-like
  ENST ID: ENST00000409954
  CDS Start-End: 165-574
aaggaactcagtgaccacagacggatgagaacagcggacgcagctgcctcccaggcactcaaaggctcaactccccacaggcgtgtgttgccaggggcagaaggcttggcccctgggtcagcatactctccggacagctcatccctgccagcccagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataat

SEQ ID NO: 152020 - DNA, 1819 bp, Homo sapiens
  Payload ID: 9926
  Gene Symbol: MCF2L
  Gene Name: MCF.2 cell line derived transforming sequence-like
  ENST ID: ENST00000453297
  CDS Start-End: 1-1009
ggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaagatgacacggtcactagctctgcctcagaaagctctgcgctttccagaaagcgctttaccctgcagggttttgctaacctcaaaggtcagaaagcttctcctaccagtcctgacaaaaaagccaagcggcatgaagtaaagagcgacccgactccctttggtgtgcgaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaa

SEQ ID NO: 152021 - DNA, 557 bp, Homo sapiens
  Payload ID: 9926
  Gene Symbol: MCF2L
  Gene Name: MCF.2 cell line derived transforming sequence-like
  ENST ID: ENST00000433807
  CDS Start-End: 266-557
tttttcctcaagttcctctcgggcgggcacggtgtgtcgcctggacctgcatgtaaacatcagggcggagcaggaatcggcctccaggagggtaattgcctggcgtactctgtcccaggtagtgggtgaaatgaaagtaaaaagccagctggtccctcatgcagattttaggggacaaagttcagcatagaaaggtcctgttacaaggagagggttgtggcgagcccagggcagcgcgcgtcctccccggcagctgatcctcgccatgggggacggaaaggctgtccggatttccgtggcggaaatgaaaagctactacctgtattctgagtggtgctcctggctgctgtccgtggctgaggatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatcc

SEQ ID NO: 152022 - DNA, 370 bp, Homo sapiens
  Payload ID: 9926
  Gene Symbol: MCF2L
  Gene Name: MCF.2 cell line derived transforming sequence-like
  ENST ID: ENST00000441756
  CDS Start-End: 1-262
ctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggtgcccacccagcctcctgtagagcccactcgtgggtgcaccttcctcagaggagacagtccccacccccctaccctttatgtcatagaatgctgtcactgagccttcctaactatacatacaattctcattttgtaagaaaatggaactgctaagcatggatttgcatttgaaaaaacattcattgttaatgtcagaagcaagaaaaag

SEQ ID NO: 152023 - DNA, 3560 bp, Homo sapiens
  Payload ID: 9926
  Gene Symbol: MCF2L
  Gene Name: MCF.2 cell line derived transforming sequence-like
  Uniprot ID: O15068
  ENST ID: ENST00000421756
  CDS Start-End: 357-3560
agaacttgcacacagcaggcaggcccagcggctgggtttctctagcacctcggcattgtctgcctgctcttccaggcgtgcagggcagtggtggctcgggccaggctctgggaggccgggcactctgaggaggtggctcagccctcttgggttctttcttgtgagttggcgaagcccagagtcaccagggtcctgagcacctgtctcttgtgaccatgcggcacccgcccggcttttagctgtcgcagcagagacccgaaggctgtggctctagcatcagggggtcgcctgtggtccctgcgtgaagaaccagagctgcctccgctttgtagcagcctttgtgacagggcggttcgatggccgagaagggagcatcccggggaaccctgcggcggctgtggtcactgcccaggaggcgccggggaactgcagggcgctcgaggccagatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtaa

SEQ ID NO: 152024 - DNA, 2710 bp, Homo sapiens
  Payload ID: 9926
  Gene Symbol: MCF2L
  Gene Name: MCF.2 cell line derived transforming sequence-like
  ENST ID: ENST00000442625
  CDS Start-End: 9-209
gcagcctcatgtttgactgttggagatttatcctgtgcaagagacctggaagcaacagttattcttccccacaacggcccaatgaggccaaaaaggaggaaacggatcaccaaattgatgtgtctgacgtcatcaggcttgttcaagacacaccggaggcgacggccatggccacagcccctcggcgatctcagtcccctggcttgtgacccacctgagtgtgatgattcctagtccacagctccagtccggacccctcccccgggcactgcaccgccctgcctccgcagagcctccacccgcatcctacaggtctcccagagccgcgtcatccactgcagctccatccaccatagttcactgcacctctccgtccagttcctttggccagaaaccccatcgtcctcatctgtgttttcactcatgcccgtatccgacctcccgggaaatcctgttggctgtgcctccagaacagatccagaatccagccaggctaccgccctgtctcccactttgaggtcgcgctgcctctgcgcctgtccctccccaccgccgtctcgcagaacagcaagcggtgacctctcgaaggaggcgtgattaacaaagagccaaaatggcaaactgtgtggaggccgtggcgtgggctgttcctcgagagccgtgcttgtagggctggcctgggagggcatccctggtccgcagaggccggtctgtgccgcaaagcctgggcgcaggcacgggagtggcaggagggtcctggagtcaagggagcagctaaatttcaatgcagcagcttctttttgccagagatccaggttaaaaaaagaaaatgtttcaccttttaaaaaatatcatacttaagacctgcatttgttctatacccagatcatctttttagagccaaaacatcaagaaatatggcctgaaaaaggctcatgaaaatactgttctgagaattaagtgttaatgacattctgaaacctcactgtttaaagagatccactgctagtataacaggacccctgatatatttatgcatttataaatttataaaattcattgttaaaatcgagcaatgctggaagcgtctggcccacggatgatgaggaggcagagttttcagaggatgctggaggacagtgcacagctccctgccagtggctgcggctttcaggctgctgggacagtggccggatgcagacctgtgtggagcagctgctgctgctgcagcgaggttggccacataggtgacgccctgctaggcgcatccaggtccagcctcgaggttgtccactttgaggccaggtctgctgggaatccaggcctgctgtgtctacactctcacactccttaaactctcctgaccgggacacacgatgaggttttcctatcaaactctacatgcatttcgtatgacatctctggatttcatcagctccgagtaaaccaagccttacttacagccaggaaggcattcaatacccagatctggtcacattctgcccattggtgcatgttttagaagcatgtgtgtgtttctgcccacctcatggctgctgaggaacagtggctactgcgtgtcgttcttgtgatgcctttgtgattttgtgtgcagagccttatttacaggccgcccccgagagcaaaggataatggtgcattatctgttgacgtgaccctggagagctctaactgaactgcacaaatgggagaatcctcccctaccggcccctgctgctcacagacagtacgctcagctcagcaggggctgctcttacaaatgccatcgcagcacaggcggtcaatgcttggcattttctggggcccctggtttccttttagaggacgcagtattttcagaaatggagttcacatgtgtgctcatcagtcagcagcagtcagctgtgatgtctccaaactgtagaggctttggactttttggcccactttcttcatagaacgatagagatttaggatcttactgccctagtttaatcttggtttgcagatgagaggccgaggccccggggtcctgagccacgtgagctgggcttccaccctggactccatgccgcgcctcctcgccagatagacgccagatagacgccagatagacgtggccagtcgtgctgtttcaaggtcttattccagtcaggtttttgttttattgatttttttgttcatgaagtagaatatggttcatgtattacatacttttctgtgtgtgtgtttttattacaatatctcattttcatgggtttttataacttaagttacctctaacctatgacccttgtagtctcttcttccaccttgtgtatcctaatgtgggaattctgctttggtggatgacttttgtgaagtgaattaacatacatttcatttagaataatgctttgagcaactcaaagaaagtgaatttaattttatcacttagtttttattttatacttaaagagctctatttgccttattcagatttttgctatcagtgttgtatatacacaaagggaagctaagcaaaataacttggttagattttcctaaaatttcttcattcagcatccaactcttctgactcccttacctgggacgttccccagctgtcgccgtcagtcttcctcagatgccagtttgttgaggtgtttctctttccctgatgcctcttgtgccaacaaataaagactttcagctcttcctgggctctcga

SEQ ID NO: 152025 - DNA, 566 bp, Homo sapiens
  Payload ID: 9926
  Gene Symbol: MCF2L
  Gene Name: MCF.2 cell line derived transforming sequence-like
  ENST ID: ENST00000420013
  CDS Start-End: 1-566
tcaagaagctggaagaaaggaaaacagaccccctaagcctggagggatacgtcagctcagcgccactgacaaagccccccgaaaagggcaaagcttctcctaccagtcctgacaaaaaagccaagcggcatgaagtaaagagcgacccgactccctttggtgtgcgaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccag

SEQ ID NO: 152026 - DNA, 734 bp, Homo sapiens
  Payload ID: 9926
  Gene Symbol: MCF2L
  Gene Name: MCF.2 cell line derived transforming sequence-like
  ENST ID: ENST00000423251
  CDS Start-End: 1-642
accagcacgggcacctcagatgccaggaccggcgtgatcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggtacatggggggtgctccggctggaagctgtggggggctccggtcagtcagaagctgcgcggggctccggtcggaagctgcggggggtctttcgtcccagcgggagtttgtgtcagcagcacgtaagaccaagaagtcagcaggcttgagatgccttttgatggcaattagctcggcaacctctccgacgagaacggaataaaaggagtgtaaatgaa

SEQ ID NO: 152027 - DNA, 952 bp, Homo sapiens
  Payload ID: 9926
  Gene Symbol: MCF2L
  Gene Name: MCF.2 cell line derived transforming sequence-like
  ENST ID: ENST00000413354
  CDS Start-End: 1-952
tcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaagatgacacggtcactagctctgcctcagaaagctctgcgctttccagaaagcgctttaccctgcagggttttgctaacctcaaagcttctcctaccagtcctgacaaaaaagccaagcggcatgaagtaaagagcgacccgactccctttggtgtgcgaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcgga

SEQ ID NO: 152028 - DNA, 453 bp, Homo sapiens
  Payload ID: 9926
  Gene Symbol: MCF2L
  Gene Name: MCF.2 cell line derived transforming sequence-like
  ENST ID: ENST00000439475
  CDS Start-End: 1-453
ccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaagatgacacggtcactagctctgcctcagaaagctctgcgctttccagaaagcgctttaccctgcagggttttgctaacctcaaaggtcagaaaggttggagcaaaacgtcccactcactggaggcacctgaggacgacgggggctggtcaagtgcagaggagcagattaactcgtccgacgcaga

SEQ ID NO: 152029 - DNA, 3752 bp, Homo sapiens
  Payload ID: 9926
  Gene Symbol: MCF2L
  Gene Name: MCF.2 cell line derived transforming sequence-like
  Uniprot ID: O15068
  ENST ID: ENST00000535094
  CDS Start-End: 160-3537
caatcctgggcagggaggcggcggctggaggctgaaagcgctgccgtggccccctccccgcctccgccgcgccccctccgcactcgcacggccccacccgcaggcgccccccgtgcggaggaagcggatctgccaggatcatttttgttgtgtcggaggatgaggttttggctgaggactgaagagatggccttggaagaaatggtgcagagattaaatgcggtttccaagcacacggatgaaatcatgcaccaggacatcgtcccgctctgtgctgccgacatccaggaccagctaaagaagcgctttgcttacctgtccggtgggcgggggcaggacggaagcccggttatcaccttccctgactacccggccttcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcagcatctttcccggcaaacctgcagctcgtcctcgtgcttcgcccgacgggttttttccaaaggactctctccgacatcgctttcaaattcaatagagatgactttaagatgaaggtgccggtcataatgctgagctccgtaccagacttacacggttacatcgataagtcgcagctgaccgaggacctgggtgggaccctggactactgccactcccggtggctgtgccagcgcacggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggaggatttgaggctggcactgaaagaggggcacagtgtcctggagagcctcagggagctgcaggctgagggctcagagcccagtgtgaaccaggaccagcttgacaaccaggccaccgtgcagaggctcctggcccagctgaacgaaaccgaggctgccttcgatgagttctgggcaaagcatcagcagaaactggagcagtgtctgcagctccggcactttgagcagggcttccgggaggtcaaagccatcttggacgcagcgtcccagaagatagcaaccttcacagacatcggcaacagcctggcgcatgtggagcacctgctgagggacctggccagcttcgaggagaaatcaggcgtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacgtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggcattcggcgaggctctgagaactccagctccgagggcggtgcgctccggagagggccctaccggagggccaagagtgagatgagtgagagccggcagggccgcggctcagcgggggaggaggaggaaagcctggccatcctgcgcaggcacgtgatgagcgagctcctggacacagaacgggcctacgtggaggagctgctgtgcgtcctggagggctacgccgcggagatggataacccactgatggctcacctcctgtcaacaggccttcacaacaagaaggatgttttgtttggaaacatggaggaaatctatcacttccacaacaggatattcctcagggagctggaaaactacactgactgcccagaactggttggaagatgctttctggagaggatggaagatttccagatctatgagaagtactgtcagaacaagccccgctctgagagcctgtggagacagtgctccgactgcccgtttttccaggaatgccagagaaagctggaccacaagctgagcctggactcctacctgctgaagccagtgcagaggatcaccaagtaccagctgctgctcaaggaaatgctgaaatacagcaggaactgcgagggggctgaggacctgcaggaggcgctgagctccatcctgggcatcctgaaggccgtgaacgactccatgcacctcatcgctatcaccggctatgacgggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacatggctgccgttggcattacggagaacgtgaagggagatgctaagaagttcgagatctggtacaacgcgcgcgaggaggtctacatcgtccaggcgccaactcctgagattaaagccgcgtgggtgaatgaaattcggaaagtgctgaccagccagctgcaggcttgtagagaagccagccagcaccgggcgctggagcagtcacagagcctgcccctgccggccccgaccagcaccagtccctcaagaggaaactcaaggaacatcaagaagctggaagaaaggaaaacagaccccctaagcctggagggatacgtcagctcagcgccactgacaaagccccccgaaaagggcaaaggttggagcaaaacgtcccactcactggaggcacctgaggacgacgggggctggtcaagtgcagaggagcagattaactcgtccgacgcagaggaggacggcgggttgggccccaagaagctggttccaggtaaatacacggtcgtggcggaccacgagaagggaggccccgatgcgctgcgcgtgaggagcggggacgtggtggagctggtgcaggagggcgacgagggcctctggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagagg

SEQ ID NO: 152030 - DNA, 361 bp, Homo sapiens
  Payload ID: 9926
  Gene Symbol: MCF2L
  Gene Name: MCF.2 cell line derived transforming sequence-like
  ENST ID: ENST00000486806
  CDS Start-End: 1-282
agcccggttatcaccttccctgactacccggccttcagcgagattccggacaaggagttccagaatgtcatgacctacctcaccagcatccccagcattttgttcatggagtctgctgcttctgagcactggggacaagtcgcggaggccctgccattccttcctccgggttctgcacgcaccgcggtgaccacctccccccgaggtcctctccccgcaccttcccaaaacgtgttccccaggtccttttctgttactgctgttgaattcaacagctactgaccacctgtggccatttaaatgtaaaatgaaagcaaaataaaattaaaaatccagcccatggcaggcagggctgcctctt

SEQ ID NO: 152031 - DNA, 399 bp, Homo sapiens
  Payload ID: 9926
  Gene Symbol: MCF2L
  Gene Name: MCF.2 cell line derived transforming sequence-like
  ENST ID: ENST00000473345
  CDS Start-End: 1-209
tcagcgagattccggacaaggagttccagaatgtcatgacctacctcaccagcatccccagcctgcaggacgctggcatcggattcatcctggtgatagaccggcgacgggacaaatggacctccgtgaaggcgtccgtcctgcgcatcgcacttagagctcgttgcacggagtcagaacccctgcatcccggtggctcaggcatttgagtgaaggtcggatcaggagggaggggagatgcagctgccccacgcatggaggagaagagctgtgagctgcagcagcctcgtgtctttttcctctcaactttcagttcagaaaaatttcagacctacagaaaacttgggagagtctcacagtgaacaaacctcagctgtggccataaacaaagtgcccatt

SEQ ID NO: 152032 - DNA, 4980 bp, Homo sapiens
  Payload ID: 9927
  Gene Symbol: MCF2L2
  Gene Name: MCF.2 cell line derived transforming sequence-like 2
  Uniprot ID: Q86YR7
  ENST ID: ENST00000328913
  CDS Start-End: 299-3643
cggggcgcggttccggcgagattggcgacttgcttccttttgcagaacggccgctcctctctcggtccagctgcgacgctgggaaagcgccagacttggtctgtcacgggagcccccgcggggcgtggcgagggagagctggcctaggctgcgagggactctcgtttcttgcctggagagccaggaagagggcgagggcagagcatccttgggcggagatgcctttaaaaaatcatccaccgcagcggtagaaacagttttgtttggctttatttatacggaatggtttttcagtgaaatgctgtcttgcttaaaagaagagatgcctccccaggagctcacccggcgactggccacagtgatcactcatgtcgatgaaattatgcagcaggaagtcagacccctgatggcggtggagataatagaacaacttcacagacaatttgccattctttcaggaggccgaggggaggatggcgcccccatcatcacgttcccagagttttcggggttcaaacacatcccagatgaagacttcctgaatgtcatgacctacctgactagcatccccagtgtggaggctgccagcattggattcattgttgttatcgacagacgaagagacaagtggagctccgtaaaggcatccttgacacgaatagctgtggcatttccaggaaacttacagctcatattcatccttcgtccatctcgctttatccagaggacattcactgacattggcattaaatactatcgaaatgagtttaaaacgaaagtgccgatcatcatggtaaactctgtctctgaccttcacggctacatcgacaaaagccaactgacccgggaattaggggggactttggaatatcgccacggtcagtgggtaaatcaccgcactgccatcgaaaactttgccttgaccttgaagaccactgcccagatgctgcagacgtttgggtcctgcctggccacagcagagctgcccagaagcatgctatccacggaagaccttctcatgtcccacacaaggcagcgggacaagctgcaggatgagctgaaattacttggaaagcaggggaccacattgctgtcatgcatccaagaaccagcaaccaaatgtcccaacagcaaactcaatctcaaccaacttgagaatgtaactaccatggaaaggttattagttcaactggatgaaacagaaaaagcctttagtcacttttggtctgagcatcatctgaagcttaaccagtgcctacaactacagcattttgagcacgatttttgtaaggctaagcttgccctggataatttgctggaagagcaagcagagtttacaggcattggagacagcgtgatgcacgtggagcagattcttaaggaacacaaaaaactggaggaaaaaagccaggagcccctggaaaaggcccagctgctggcactggttggggaccagctcatccaaagccaccattatgcagcagatgccatcaggccccggtgtgtggagctcaggcacctctgtgacgatttcatcaatggaaacaagaaaaaatgggacattttaggaaagtccttagagtttcatagacagctggacaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggccaaagcccagaaagttttgcagaggctggatgatgtccaggaaatatttcacaagaggcaagtgagtctgatgaaactggcagccaaacagactcgtccagtgcaacctgtggccccacatcctgagtcttcaccaaaatgggtgtcatcaaaaaccagccagccctccacctcggtccctctagctcgtcctctgagaacgtctgaggaaccttatacggagacagagttgaactcccggggaaaggaagatgatgagactaaatttgaagtcaagagtgaagaaatctttgaaagccatcatgaaagggggaaccctgagctggagcagcaggccaggctcggagacctttccccccgcaggcgcattatacgtgacttgcttgagactgaagagatttacataaaagagattaaaagcataattgatggatatatcactccaatggattttatttggctaaagcatctaattccagatgttcttcagaataacaaggactttctctttgggaatattagagaactttacgaatttcacaacaggacttttctaaaagagttggaaaagtgtgctgagaaccctgaacttctggcacattgctttctcaagagaaaagaagatcttcagatatattttaaataccataagaatctgccccgagctagggcaatctggcaagagtgtcaagactgcgcctactttggggtatgccagcgccaactggatcacaatctccctctttttaagtatctcaaaggaccaagccagagacttataaaataccagatgctgttgaagggtctgctggatttcgagtctcctgaagatatggagatagacccaggtgaactaggaggctcggctaaggatgggccaaagagaaccaaagattcagcattctcaactgaactacaacaagctttggcagtgatagaggatttgatcaagtcctgtgagttggctgtggacctagcagcagtgactgaatgtccggacgatattggaaaactaggcaagctgttgctgcacggccctttcagcgtctggacaattcacaaggatcgttataaaatgaaggatttgattcgatttaaacccagccagaggcaaatctacctatttgaaaggggaatagtgttctgtaagatacgaatggagcctggggaccagggattatctcctcattacagcttcaagaagaccatgaagctgatgacactttcaattcgccagcttggaagggggagccatagaaagtttgagattgccagtcgaaatggacttgagaaatacatcctgcaggcagcttcaaaagaaatcagagactgttggttttcagaaataagtaaattattgatggaacaacaaaataatatcaaagaccaaggaaatccacagtttgaaatgagcacgagcaaaggcagtggagcaggatccggaccatggattaaaaatatggaaagagctaccactagcaaggaagacccggcctccagcacaggagggattaaaggctgctccagcagggagtttagctccatggacacctttgaagactgtgaaggcgcagaagacatggaaaaggagagcagtgctctgagtctcgcgggccttttccagtcggacgacagtcacgaaacctgttcctccaaatctgctttcctggagaggggagaaagcagccagggagaaaaagaagaacgcgatgaggaggaaacggcgacccgcagcaccgaggaggagcgcgctggggcgtccacgggccggctggctcctgcgggggcgacggctggtttccaggcgagggcgctgcgcccgaggacctccgcccaggagagctgacctccctgcggacgcccccgctcctcggctccagagcgcccgcattcccgggagaggcggtgtgggggcccgggccctgcccagctacgcagaaagcagccggagcctcggcggcggcagaaaggggacaaccagggcctcctccgaggagcccgaggggtgtcctgggtgcgcgcctagctccgcacgggggacctcggagctgctctaaggcgcctgcagaggcgagcagagcccgcagcccacgccttctcgaccgcgcacttcgatattcggagccgggcaattctttgctgcgtgggcttctctgtgctcccacggtaggatgtttagtagcacccctggcctctacccactaggtgccaggaatgcgccaccccatcctccaccccgcccccaaatcgtgacaatcaaaaatgcctgcagacacgcccgcatttctccagggcggggtgggaatcggttgagagccgcttagcccgagccttggaggagccggagccgctccaacccggcgggggccgcagactgggagctcccggtccgcctcccagcatccctgcgagcgttcatggggtgttcgtgttagtgccaagattgcttcgttgtagagagagttcgttccaagttactttctgaggtattttatgtatcgatttattagtttttaaatgagttttgttagtttcagttgtattttatttttagttttattagttgattttcatttctttgtagctttctggttatttaattttatagtttcagttactggtttatagttactttattttcaaagttatttagttgttcattttcagttatttatatgtagttgttttgttttaggagttacagatgttcaaattaatttgcttggaatttatttatttatttatttatttatttttcgagacggagtctcgctctgtcgcccaggctggagtgcagtggtgtgatctcggctcactgcaaaccgcctcccgggttcacgccattctcctgcctcagcctcctgagtagctgggactacaggcgcccgccaccacgcccggctaattttttatttggatttttagtagagacggggtttccccgtgttagccaggatggtctcgatctcctgacctcgtgatccccctgcctcggcctcccaaagtgctgggattacaggcgtgagccaccgcgcccagccggaatttatttttaattatctttacaattattatctgagttatttaccttcatagttatttcactttatcttattggagtttttgagttatttatttttacagtaacttatttgactattaaacactcactggaagttcatg

SEQ ID NO: 152033 - DNA, 2394 bp, Homo sapiens
  Payload ID: 9927
  Gene Symbol: MCF2L2
  Gene Name: MCF.2 cell line derived transforming sequence-like 2
  Uniprot ID: Q86YR7
  ENST ID: ENST00000447025
  CDS Start-End: 109-2244
ggcgagggcagagcatccttgggcggagatgcctttaaaaaatcatccaccgcagcggtagaaacagttttgtttggctttatttatacggaatggtttttcagtgaaatgctgtcttgcttaaaagaagagatgcctccccaggagctcacccggcgactggccacagtgatcactcatgtcgatgaaattatgcagcaggaagtcagacccctgatggcggtggagataatagaacaacttcacagacaatttgccattctttcaggaggccgaggggaggatggcgcccccatcatcacgttcccagagttttcggggttcaaacacatcccagatgaagacttcctgaatgtcatgacctacctgactagcatccccagtgtggaggctgccagcattggattcattgttgttatcgacagacgaagagacaagtggagctccgtaaaggcatccttgacacgaatagctgtggcatttccaggaaacttacagctcatattcatccttcgtccatctcgctttatccagaggacattcactgacattggcattaaatactatcgaaatgagtttaaaacgaaagtgccgatcatcatggtaaactctgtctctgaccttcacggctacatcgacaaaagccaactgacccgggaattaggggggactttggaatatcgccacggtcagtgggtaaatcaccgcactgccatcgaaaactttgccttgaccttgaagaccactgcccagatgctgcagacgtttgggtcctgcctggccacagcagagctgcccagaagcatgctatccacggaagaccttctcatgtcccacacaaggcagcgggacaagctgcaggatgagctgaaattacttggaaagcaggggaccacattgctgtcatgcatccaagaaccagcaaccaaatgtcccaacagcaaactcaatctcaaccaacttgagaatgtaactaccatggaaaggttattagttcaactggatgaaacagaaaaagcctttagtcacttttggtctgagcatcatctgaagcttaaccagtgcctacaactacagcattttgagcacgatttttgtaaggctaagcttgccctggataatttgctggaagagcaagcagagtttacaggcattggagacagcgtgatgcacgtggagcagattcttaaggaacacaaaaaactggaggaaaaaagccaggagcccctggaaaaggcccagctgctggcactggttggggaccagctcatccaaagccaccattatgcagcagatgccatcaggccccggtgtgtggagctcaggcacctctgtgacgatttcatcaatggaaacaagaaaaaatgggacattttaggaaagtccttagagtttcatagacagctggacaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggccaaagcccagaaagttttgcagaggctggatgatgtccaggaaatatttcacaagaggcaagtgagtctgatgaaactggcagccaaacagactcgtccagtgcaacctgtggccccacatcctgagtcttcaccaaaatgggtgtcatcaaaaaccagccagccctccacctcggtccctctagctcgtcctctgagaacgtctgaggaaccttatacggagacagagttgaactcccggggaaaggaagatgatgagactaaatttgaagtcaagagtgaagaaatctttgaaagccatcatgaaagggggaaccctgagctggagcagcaggccaggctcggagacctttccccccgcaggcgcattatacgtgacttgcttgagactgaagagatttacataaaagagattaaaagcataattgatggatatatcactccaatggattttatttggctaaagcatctaattccagatgttcttcagaataacaaggactttctctttgggaatattagagaactttacgaatttcacaacaggacttttctaaaagagttggaaaagtgtgctgagaaccctgaacttctggcacattgctttctcaagagagtaagtctgtactcccagtaaataatcatgttaaagtcagcccttacatttctgcgttaagtggcaaggacaaatggaaacatcaatggtctaaaaacatatctgcttccctccgactccaagctttactgaagtataattggtaaataaaaattgcatatattcaaacta

SEQ ID NO: 152034 - DNA, 3031 bp, Homo sapiens
  Payload ID: 9927
  Gene Symbol: MCF2L2
  Gene Name: MCF.2 cell line derived transforming sequence-like 2
  Uniprot ID: Q86YR7
  ENST ID: ENST00000414362
  CDS Start-End: 125-2011
ggagagccaggaagagggcgagggcagagcatccttgggcggagatgcctttaaaaaatcatccaccgcagcggtagaaacagttttgtttggctttatttatacggaatggtttttcagtgaaatgctgtcttgcttaaaagaagagatgcctccccaggagctcacccggcgactggccacagtgatcactcatgtcgatgaaattatgcagcaggaagtcagacccctgatggcggtggagataatagaacaacttcacagacaatttgccattctttcaggaggccgaggggaggatggcgcccccatcatcacgttcccagagttttcggggttcaaacacatcccagatgaagacttcctgaatgtcatgacctacctgactagcatccccagtgtggaggctgccagcattggattcattgttgttatcgacagacgaagagacaagtggagctccgtaaaggcatccttgacacgaatagctgtggcatttccaggaaacttacagctcatattcatccttcgtccatctcgctttatccagaggacattcactgacattggcattaaatactatcgaaatgagtttaaaacgaaagtgccgatcatcatggtaaactctgtctctgaccttcacggctacatcgacaaaagccaactgacccgggaattaggggggactttggaatatcgccacggtcagtgggtaaatcaccgcactgccatcgaaaactttgccttgaccttgaagaccactgcccagatgctgcagacgtttgggtcctgcctggccacagcagagctgcccagaagcatgctatccacggaagaccttctcatgtcccacacaaggcagcgggacaagctgcaggatgagctgaaattacttggaaagcaggggaccacattgctgtcatgcatccaagaaccagcaaccaaatgtcccaacagcaaactcaatctcaaccaacttgagaatgtaactaccatggaaaggttattagttcaactggatgaaacagaaaaagcctttagtcacttttggtctgagcatcatctgaagcttaaccagtgcctacaactacagcattttgagcacgatttttgtaaggctaagcttgccctggataatttgctggaagagcaagcagagtttacaggcattggagacagcgtgatgcacgtggagcagattcttaaggaacacaaaaaactggaggaaaaaagccaggagcccctggaaaaggcccagctgctggcactggttggggaccagctcatccaaagccaccattatgcagcagatgccatcaggccccggtgtgtggagctcaggcacctctgtgacgatttcatcaatggaaacaagaaaaaatgggacattttaggaaagtccttagagtttcatagacagctggacaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggccaaagcccagaaagttttgcagaggctggatgatgtccaggaaatatttcacaagaggcaagtgagtctgatgaaactggcagccaaacagactcgtccagtgcaacctgtggccccacatcctgagtcttcaccaaaatgggtgtcatcaaaaaccagccagccctccacctcggtccctctagctcgtcctctgagaacgtctgaggaaccttatacggagacagagttgaactcccggggaaaggaagatgatgagactaaatttgaagtcaagagtgaagaaatctttgaaagccatcatgaaagggggaaccctgagctggagcagcaggccaggctcggagacctttccccccgcagatactcttctcagtactttaagtaagtgtgatgaaggaatcatctagcaacttccttcttagaaaaaaaggaagtgccttcatatttccttgaaatttaaacttgttccattctattctaagcaaaaattaaaaggacacagttcagaagagctctttcagcaaataaataattgtttcacaaaagcactgctgtaaacaagatcactttgatggccagagacacttatgttttcaaccaatggcaaccttaaacacttccaagtatagatacacagggtatatatgggcaaaaggcaatacatcattaatcaatcaactaataaaaattaattataagcttgttgcttggtcaaatatgcttttgttctctatgtttttttaattggtcagaaaacttaaactgtaatgatctaaaaccctgtatctactctgaaagtaactacaacctagaatgtttgacactgtagttttgacattagttaaaaattctaaattatctaagcaatgtaaacaagcctcaaatttcaaaatagaaaaaaattaaaatttctgtaaacattaaaaagctacctgctaaaaattgtaagtatcatcattcagttgtgtatactgagaaatcttttttcgttttgttttgcgtgtttccgacatcaccttattatatgagacatctgattttccctaacaggtgcctctgcagtcaaaggccttagagtgagttcagtcactcttgctgaagtcattattttggccttcatataatctccctagcagtagacaccacctagttctttctgtagtgaagggaggtagtgtgtattatagccacatttttatcctgctttgtaaaataaatgtaacttactctattagatctcagacacatctctttgattacaaggaacatgcagctttaaaaatgctttaaccccaaactggcaacttttctatcacttttttactctgttttcaagtttgaaatatttagaaaataaagatcacctctgacagttattgatgaaaaataaattgttttagatatt

SEQ ID NO: 152035 - DNA, 570 bp, Homo sapiens
  Payload ID: 9927
  Gene Symbol: MCF2L2
  Gene Name: MCF.2 cell line derived transforming sequence-like 2
  ENST ID: ENST00000482017
  CDS Start-End: 198-570
agcctcccgctccgggtcctgccggatggcggcagctctccgggccagcccccttctctccgcggctcctccgcagacacccggcgcggaagaaggaggggcggagacctggccggcgcgcgtctgatgatccggaccccggtgcgactggagcgcctcagtcactgtctccccgccccacggttccgaatgaaattatgcagcaggaagtcagacccctgatggcggtggagataatagaacaacttcacagacaatttgccattctttcaggaggccgaggggaggatggcgcccccatcatcacgttcccagagttttcggggttcaaacacatcccagatgaagacttcctgaatgtcatgacctacctgactagcatccccagtgtggaggctgccagcattggattcattgttgttatcgacagacgaagagacaagtggagctccgtaaaggcatccttgacacgaatagctgtggcatttccaggaaacttacagctcatattcatccttcgtccatctcgctttatccagaggacattcactgacattggcattaaatact

SEQ ID NO: 152036 - DNA, 4748 bp, Homo sapiens
  Payload ID: 9927
  Gene Symbol: MCF2L2
  Gene Name: MCF.2 cell line derived transforming sequence-like 2
  Uniprot ID: Q86YR7
  ENST ID: ENST00000473233
  CDS Start-End: 1-3225
atgctgtcttgcttaaaagaagagatgcctccccaggagctcacccggcgactggccacagtgatcactcatgtcgatgaaattatgcagcaggaagtcagacccctgatggcggtggagataatagaacaacttcacagacaatttgccattctttcaggaggccgaggggaggatggcgcccccatcatcacgttcccagagttttcggggttcaaacacatcccagatgaagacttcctgaatgtcatgacctacctgactagcatccccagtgtggaggctgccagcattggattcattgttgttatcgacagacgaagagacaagtggagctccgtaaaggcatccttgacacgaatagctgtggcatttccaggaaacttacagctcatattcatccttcgtccatctcgctttatccagaggacattcactgacattggcattaaatactatcgaaatgagtttaaaacgaaagtgccgatcatcatggtaaactctgtctctgaccttcacggctacatcgacaaaagccaactgacccgggaattaggggggactttggaatatcgccacggtcagtgggtaaatcaccgcactgccatcgaaaactttgccttgaccttgaagaccactgcccagatgctgcagacgtttgggtcctgcctggccacagcagagctgcccagaagcatgctatccacggaagaccttctcatgtcccacacaaggcagcgggacaagctgcaggatgagctgaaattacttggaaagcaggggaccacattgctgtcatgcatccaagaaccagcaaccaaatgtcccaacagcaaactcaatctcaaccaacttgagaatgtaactaccatggaaaggttattagttcaactggatgaaacagaaaaagcctttagtcacttttggtctgagcatcatctgaagcttaaccagtgcctacaactacagcattttgagcacgatttttgtaaggctaagcttgccctggataatttgctggaagagcaagcagagtttacaggcattggagacagcgtgatgcacgtggagcagattcttaaggaacacaaaaaactggaggaaaaaagccaggagcccctggaaaaggcccagctgctggcactggttggggaccagctcatccaaagccaccattatgcagcagatgccatcaggccccggtgtgtggagctcaggcacctctgtgacgatttcatcaatggaaacaagaaaaaatgggacattttaggaaagtccttagagtttcatagacagctggacaaggtcagccaatggtgtgaggcaggaatctacctcttggcttcccaagctgtagacaagtgccagtctcgagaaggggttgatatcgccttgaacgacattgcgacattcctgggcacagtcaaggagtacccgttgctcagccccaaggagttttacaacgagtttgagttgctgctcaccctcgatgcaaaggccaaagcccagaaagttttgcagaggctggatgatgtccaggaaatatttcacaagaggcaagtgagtctgatgaaactggcagccaaacagactcgtccagtgcaacctgtggccccacatcctgagtcttcaccaaaatgggtgtcatcaaaaaccagccagccctccacctcggtccctctagctcgtcctctgagaacgtctgaggaaccttatacggagacagagttgaactcccggggaaaggaagatgatgagactaaatttgaagtcaagagtgaagaaatctttgaaagccatcatgaaagggggaaccctgagctggagcagcaggccaggctcggagacctttccccccgcaggcgcattatacgtgacttgcttgagactgaagagatttacataaaagagattaaaagcataattgatggatatatcactccaatggattttatttggctaaagcatctaattccagatgttcttcagaataacaaggactttctctttgggaatattagagaactttacgaatttcacaacaggacttttctaaaagagttggaaaagtgtgctgagaaccctgaacttctggcacattgctttctcaagagaaaagaagatcttcagatatattttaaataccataagaatctgccccgagctagggcaatctggcaagagtgtcaagactgcgcctactttggggtatgccagcgccaactggatcacaatctccctctttttaagtatctcaaaggaccaagccagagacttataaaataccagatgctgttgaagggtctgctggatttcgagtctcctgaagatatggagatagacccaggtgaactaggaggctcggctaaggatgggccaaagagaaccaaagattcagcattctcaactgaactacaacaagctttggcagtgatagaggatttgatcaagtcctgtgagttggctgtggacctagcagcagtgactgaatgtccggacgatattggaaaactaggcaagctgttgctgcacggccctttcagcgtctggacaattcacaaggatcgttataaaatgaaggatttgattcgatttaaacccagccagaggcaaatctacctatttgaaaggggaatagtgttctgtaagatacgaatggagcctggggaccagggattatctcctcattacagcttcaagaagaccatgaagctgatgacactttcaattcgccagcttggaagggggagccatagaaagtttgagattgccagtcgaaatggacttgagaaatacatcctgcaggcagcttcaaaagaaatcagagactgttggttttcagaaataagtaaattattgatggaacaacaaaataatatcaaagaccaaggaaatccacagtttgaaatgagcacgagcaaaggcagtggagcaggatccggaccatggattaaaaatatggaaagagctaccactagcaaggaagacccggcctccagcacaggagggattaaaggctgctccagcagggagtttagctccatggacacctttgaagactgtgaaggcgcagaagacatggaaaaggagagcagtgctctgagtctcgcgggccttttccagtcggacgacagtcacgaaacctgttcctccaaatctgctttcctggagaggggagaaagcagccagggagaaaaagaagaacgcgatgaggaggaaacgtgagtgtgagcgaggaaagactaagcgcctctttgggccacggcgtctctgactttcttctcggaattgcagggcgacccgcagcaccgaggaggagcgcgctggggcgtccacgggccggctggctcctgcgggggcgacggctggtttccaggcgagggcgctgcgcccgaggacctccgcccaggagagctgacctccctgcggacgcccccgctcctcggctccagagcgcccgcattcccgggagaggcggtgtgggggcccgggccctgcccagctacgcagaaagcagccggagcctcggcggcggcagaaaggggacaaccagggcctcctccgaggagcccgaggggtgtcctgggtgcgcgcctagctccgcacgggggacctcggagctgctctaaggcgcctgcagaggcgagcagagcccgcagcccacgccttctcgaccgcgcacttcgatattcggagccgggcaattctttgctgcgtgggcttctctgtgctcccacggtaggatgtttagtagcacccctggcctctacccactaggtgccaggaatgcgccaccccatcctccaccccgcccccaaatcgtgacaatcaaaaatgcctgcagacacgcccgcatttctccagggcggggtgggaatcggttgagagccgcttagcccgagccttggaggagccggagccgctccaacccggcgggggccgcagactgggagctcccggtccgcctcccagcatccctgcgagcgttcatggggtgttcgtgttagtgccaagattgcttcgttgtagagagagttcgttccaagttactttctgaggtattttatgtatcgatttattagtttttaaatgagttttgttagtttcagttgtattttatttttagttttattagttgattttcatttctttgtagctttctggttatttaattttatagtttcagttactggtttatagttactttattttcaaagttatttagttgttcattttcagttatttatatgtagttgttttgttttaggagttacagatgttcaaattaatttgcttggaatttatttatttatttatttatttatttttcgagacggagtctcgctctgtcgcccaggctggagtgcagtggtgtgatctcggctcactgcaaaccgcctcccgggttcacgccattctcctgcctcagcctcctgagtagctgggactacaggcgcccgccaccacgcccggctaattttttatttggatttttagtagagacggggtttccccgtgttagccaggatggtctcgatctcctgacctcgtgatccccctgcctcggcctcccaaagtgctgggattacaggcgtgagccaccgcgcccagccggaatttatttttaattatctttacaattattatctgagttatttaccttcatagttatttcactttatcttattggagtttttgagttatttatttttacagtaacttatttgactattaaacactcactggaa

SEQ ID NO: 152037 - DNA, 6714 bp, Homo sapiens
  Payload ID: 9928
  Gene Symbol: MKKS
  Gene Name: McKusick-Kaufman syndrome
  Uniprot ID: Q9NPJ1
  ENST ID: ENST00000347364
  CDS Start-End: 764-2476
gtgccctcgcgcgacgcgaaggttgtcgggatccgcggcagcagcggctgcttgagatctgtttctggggcctctggcggtggcggcctggggcggcgcgacggctggtgcgcaggtacactgatgctgaagtactatgagccttcggaacttgtggagagactacaaagttttggttgttatggtccctttagttgggctcatacatttggggtggtacagaatcaaaagcagccctgttttccaaatacctaaaaacgacgacattcctgagcaagatagtctgggactttcaaatcttcagaagagccaaatccaggggaagtagcaggcttgcaatcttcaggtaaagaagcagctttgaatctgagcttcatatcgaaagaagagatgaaaaataccagttggattagaaagaactggcttcttgtagctgggatatctttcataggtgtccatcttggaacatactttttgcagaggtctgcaaagcagtctgtaaaatttcagtctcaaagcaaacaaaagagtattgaagagtgaagtaaaataaatatttggaattactaatttgtcattaaatcattctatgctgattagcttcataaacattgaactttttgattttatagccacaatgctgcatattcatactttaattcctaaagaataatttttaatgttaaaacgtgataatgcaataaatagaaaaatgtggtttacaaaataaaaacggtcttcactagttaccacctgaagtaagatgtctcgtttggaagctaagaagccatcattgtgtaagagtgaaccactgacaactgagagagtcaggaccacactttctgtcttgaaaagaattgtaacatcatgctatggcccctcaggtaggctgaagcagctgcacaatggctttggaggttacgtgtgtacaacctcacagtcctcagctctgctcagtcaccttttggtcacacatcccattttaaagatcctgacagcctccatacagaatcatgtgtcaagcttcagtgattgtggcttattcacagctattctttgctgcaacctgattgaaaatgttcagagattaggcttgacacccaccactgtcattagattaaataaacatcttttgagtctttgcatcagttatctcaagtctgagacctgtggttgtcgaatcccagtggactttagtagtactcagatcctcctttgtttggtgcgtagtatattaacaagtaaacctgcctgtatgctcaccagaaaggaaacagagcatgtcagtgctttgatcctgagagcctttttgcttacaattccagaaaatgctgaaggccacatcattttaggaaagagtttaattgtacctttaaaaggtcaaagagttatagattccactgtattacctgggatactcattgaaatgtcagaagttcaattaatgaggctattacctatcaaaaaatcaactgccctcaaggtggcactcttttgtacaactttatccggagacacttctgacactggagaaggaactgtggtggtcagttatggggtttctcttgaaaatgcagtcttggaccagctgcttaacctaggaaggcagctaatcagtgaccacgtagatcttgtcctgtgccaaaaagttatacatccatctttgaagcagtttctcaatatgcatcgtattattgccatagacagaattggagtgactctgatggaacccctgactaaaatgacaggaacacagcctattggatccctaggctcaatatgtcctaatagttatggaagtgtgaaagatgtgtgcactgcaaaatttggctccaaacatttttttcatcttattcctaatgaagcaacaatctgcagcttgcttctctgcaacagaaatgacactgcctgggatgagctgaagctcacgtgtcagacggcactgcatgtcctgcagttaacactcaaggaaccatgggctttgttgggaggtggctgtactgaaactcatttggctgcatatatcagacacaagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgagaaaaattgtgagtgtatttgttttctcccaaagccctgttctacatatttggacaaatgactcataaaattatagatacacttatttaggaaaaaaggtgattcgtgaatggaaatgccatgaaacaataaaaatatgaagcattatttatttaaaaatattatagttatcttagggattctatactggctgctgtacattgttctaaatttttgttatgttggcatcattttgagagcaaacaaataaaaaagactcctaatccatgctctagtttggatatacatattttagatattttccagttagcagtaattacatatgcttaaagtataaaactagatctcaaagtgtcacaaaacattcagtatatattgctcaatcaaaagaagtattcaaactgcacatttagtaaaatttcacttttctccatgccctttatctcaagctatattcttcagtggttaggtaattgagtagaacctggtttgcctgcaatttgtagtttatatcacaactccacatttttgttattttggggaaatgtttgcttttggggggaaaaagtagatttatatagtaaccaaggctaaagcaacattgtaatgtcttcatttttaaagtgggaagaaggactggtttgttttacactggggtttctcaactttggcattattgacattctgagccccataattctttgttgtacggaggctgccctgtgcattacagcttactgagcagcatccctggcctctgcacactagatgccagtagcaccctcctgttgtgacaaccaaaaatgtttccagacattgccaaatgtcccccgaagagcaaaactgttgttggttgagaaccatagactgatagaaaaaggaaggacaataaggagtattctagcaggacttcagaaagcagcataaagggaaggggaagttatttctctagtcaatagtatgaaaaagaaagtagaaaatctcccatgttcaaagtagagacattatgtttcaccaagggatgtagtttgaattttatgcaaatataagatgtattgataaattgaagaagaaatatagaaggcagccacatgaataagcatggagctataacaaatgttgtattaaactttaggaaaatattttggaaatttttgggaaacaaaccaacctaatagtcaatgatcagatctatagccatgataaagagaaatagaattgttaaacaatttcctctgatattcttgtaatcaaaaagaatttttactctgagccaaaggaaaaaactagcaatacaagcagcaatgccatccatatatgttaggtatcagccccacctgaagtctcataaaatatttatcaaaagttttactccttttattattacaatcaaatagaagggcagtgtggtaggcagcctctaaggtggccccacctcctagtttcagaccttgcataatttcctccccttgagcatgggctagacttagtgactcctttatgtctcccatttcccagctttgtggacagaatgttatggtgatggttatggttatgccttatccataattttatgctgtgagtagaaggcagataacttttctctagtttcatgggtctacagatggaaagcaactgtgttccaggaactgtacttaaagaactacctcctgaggaagcctggggtgattccagttatgatatcaccctgacttgattccaattatgagattctgaactttgagctgatgttgtaatgcaaaagtgaaacttttgaggatctgaggagtaggggggacgtattttgcatgtggtaggcagcctctaagatggttcccaataatctcacttcctggtggttcactctctgggtgtaggtgggacctaatgactagcttctaatgaatagaatacagcagaagggacaggatatcacttctgatatttggtggtaaaaagatgagtttgtctcttgatgccttctctctcaatggaagccagctgtcatgttgggaactgccccctggggaggcccacatagcaagggttgagggaggcttctagccaacagctcaaaaggaactgaatcgtaccaataaccacaagagtgaatttggaagcaggttctccccagtggaaccttgagttgagtatagccctaccactggagccacacgagagaccctgatgcaaaaaagccagctaagctactcccaggttggttcctaacccacaaaatctgtgagataataaatgttgttttaagtcaaatttgggatgtactttcttatacagcaatagctatctaataaaggcaggaggaaaagcttatttgtaataaattatttactgaaaacttggtcacataaatggaaaaaagcattcttgatgccatgcctttgcatttttatcatcaccccaacctaaaagaagggttctttatcacatgtgtttacaatgtgtcacataggagttgggtattgtcctggttctctttgcccttatcctgcattttttcaagttcctccaagaaggggtgacacagcgaacctctccaattgatcttatagattaggggcttctacttttcacgatagccactttttaaattctatcatttttagctttgccatacaatttgattacattccttagtgaaacatcaatgctcttattttgaatatatcacaaattcgttaaaatatatttacaaatacctctatgtttcctaaagttataataatccctagcagaaaacactggaaatagaaaaaaagagaaaaaaaaccttcctctatagttcaagaaaattagcgttcaaacttagatgataaaacatgaaatgaaaattcttgatgaaaataattttagaggagttccttttggcagaaataaatgataagtaaaaatagcaactaaggtaagcctcaggcagtgttttgtgacttaaagtaagattgaggtctgaatattgcattatgaagtacctcaggagagagaatgggaaaccgtgatcgctgtggaaaaggaaagggagagtgtgaagaagaaaatgaagtcggtgacagctgctcaataatttcgtgggactctcaggacatgtaacattaaacgttattcaaccataggagtccaacaggattatcatcttattaatcaaaaggcattaggattttagcagcaaggaagaaagtggagagctacagcaaataaaggaaacttttaatcaaatacttatttggtcttatagatatcctaccctttaattcttccatttgtaccatattagagagtctttatatgttagacattgtaagtcaactgttagactgaagcactttatgtaagtgaagtattttacacaagatatttaaactatatcacattaatatcttttattataggtatccttgaactcatttggtttgtattatcaaagctacttaggcatttacattgtagacaagaaatttgaagtaaccataaatcagccattgtactatgtattttcatattgttgttcatattgttgagcagttctttggataactttaaaataaaataatgttgtttaccatcacatacattatgcaggttatttaaaattatcatgtaaaaaatcaatgcaggccttgacaaaacatacaattagttaggttattccttcctgataatctttggggaatagtcaaagagactaaacatctcctacaaggccctgtttcagctgtctaaataaagctatctcttaatctgaaggaaaagtcaattttgaatatctgatatctttataatttttttcatgtagctaagtgcttccatttagtaactattgtatcccataatggaagtttttgccaatcatctacagaatttgaatttagatgcacctaaacccaatgttagcctacttttggattataagtagatttatatgctgctttactaagaatatagtaatattcatgaaagagaatgcaatccctgaaaactattcctaaatgtaagtgaagctgtttgttggagagacgattagtcttggcgcactaaaatccatagaatactatattacctgtaatgaagtgtgaatttagagggaaataaaacagcttgacaatctcctattaaaaattctctttgagaaaatacttataataaacatcttattttagccatcttga

SEQ ID NO: 152038 - DNA, 2663 bp, Homo sapiens
  Payload ID: 9928
  Gene Symbol: MKKS
  Gene Name: McKusick-Kaufman syndrome
  Uniprot ID: Q9NPJ1
  ENST ID: ENST00000399054
  CDS Start-End: 888-2600
gggaaaacactttaggttgagtgctgagagaaaggctctctgagtaggtgacatctgaactaagagctgaagcagaagaataagccatcctctgtggaccaaaggggacaagattctctacttttctgctacgcactaggaatatagcagagaagacaagtggctgctaccttctgttatcgtgggtggcagtgactagtttttctagatcttgactccctgccgtaactaaagatggagtacactgatgctgaagtactatgagccttcggaacttgtggagagactacaaagttttggttgttatggtccctttagttgggctcatacatttggggtggtacagaatcaaaagcagccctgttttccaaatacctaaaaacgacgacattcctgagcaagatagtctgggactttcaaatcttcagaagagccaaatccaggggaagtagcaggcttgcaatcttcaggtaaagaagcagctttgaatctgagcttcatatcgaaagaagagatgaaaaataccagttggattagaaagaactggcttcttgtagctgggatatctttcataggtgtccatcttggaacatactttttgcagaggtctgcaaagcagtctgtaaaatttcagtctcaaagcaaacaaaagagtattgaagagtgaagtaaaataaatatttggaattactaatttgtcattaaatcattctatgctgattagcttcataaacattgaactttttgattttatagccacaatgctgcatattcatactttaattcctaaagaataatttttaatgttaaaacgtgataatgcaataaatagaaaaatgtggtttacaaaataaaaacggtcttcactagttaccacctgaagtaagatgtctcgtttggaagctaagaagccatcattgtgtaagagtgaaccactgacaactgagagagtcaggaccacactttctgtcttgaaaagaattgtaacatcatgctatggcccctcaggtaggctgaagcagctgcacaatggctttggaggttacgtgtgtacaacctcacagtcctcagctctgctcagtcaccttttggtcacacatcccattttaaagatcctgacagcctccatacagaatcatgtgtcaagcttcagtgattgtggcttattcacagctattctttgctgcaacctgattgaaaatgttcagagattaggcttgacacccaccactgtcattagattaaataaacatcttttgagtctttgcatcagttatctcaagtctgagacctgtggttgtcgaatcccagtggactttagtagtactcagatcctcctttgtttggtgcgtagtatattaacaagtaaacctgcctgtatgctcaccagaaaggaaacagagcatgtcagtgctttgatcctgagagcctttttgcttacaattccagaaaatgctgaaggccacatcattttaggaaagagtttaattgtacctttaaaaggtcaaagagttatagattccactgtattacctgggatactcattgaaatgtcagaagttcaattaatgaggctattacctatcaaaaaatcaactgccctcaaggtggcactcttttgtacaactttatccggagacacttctgacactggagaaggaactgtggtggtcagttatggggtttctcttgaaaatgcagtcttggaccagctgcttaacctaggaaggcagctaatcagtgaccacgtagatcttgtcctgtgccaaaaagttatacatccatctttgaagcagtttctcaatatgcatcgtattattgccatagacagaattggagtgactctgatggaacccctgactaaaatgacaggaacacagcctattggatccctaggctcaatatgtcctaatagttatggaagtgtgaaagatgtgtgcactgcaaaatttggctccaaacatttttttcatcttattcctaatgaagcaacaatctgcagcttgcttctctgcaacagaaatgacactgcctgggatgagctgaagctcacgtgtcagacggcactgcatgtcctgcagttaacactcaaggaaccatgggctttgttgggaggtggctgtactgaaactcatttggctgcatatatcagacacaagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgagaaaaa

SEQ ID NO: 152039 - DNA, 882 bp, Homo sapiens
  Payload ID: 9928
  Gene Symbol: MKKS
  Gene Name: McKusick-Kaufman syndrome
  ENST ID: ENST00000609375
  CDS Start-End: 261-452
gggaaaacactttaggttgagtgctgagagaaaggctctctgagtaggtgacatctgaactaagagctgaagcagaagaataagccatcctctgtggaccaaaggggacaagattctctacttttctgctacgcactaggaatatagcagagaagacaagtggctgctaccttctgttatcgtgggtggcagtgactagtttttctagatcttgactccctgccgtaactaaagatggagtacactgatgctgaagtactatgagccttcggaacttgtggagagactacaaagttttggttgttatggtccctttagttgggctcatacatttggggtggtacagaatcaaaagcagccctgttttccaaatacctaaaaacgacgacattcctgagcaagatagtctgggactttcaaatcttcagaagagccaaatccaggggaagtagcaggcttgcaatcttcaggtaaagaagcagctttgaatctgagcttcatatcgaaagaagagatgaaaaataccagttggattagaaagaactggcttcttgtagctgggatatctttcataggtgtccatcttggaacatactttttgcagaggtctgcaaagcagtctgtaaaatttcagtctcaaagcaaacaaaagagtattgaagagtgaagtaaaataaatatttggaattactaatttgtcattaaatcattctatgctgattagcttcataaacattgaactttttgattttatagccacaatgctgcatattcatactttaattcctaaagaataatttttaatgttaaaacgtgataatgcaataaatagaaaaatgtggtttacaaaataaaaacggtcttcactagttaccacctgaa

SEQ ID NO: 152040 - DNA, 2918 bp, Homo sapiens
  Payload ID: 9929
  Gene Symbol: MDM1
  Gene Name: Mdm1 nuclear protein
  Uniprot ID: Q8TC05
  ENST ID: ENST00000303145
  CDS Start-End: 88-2232
gctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtccgagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttactcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacgtgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacgttttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtg

SEQ ID NO: 152041 - DNA, 393 bp, Homo sapiens
  Payload ID: 9929
  Gene Symbol: MDM1
  Gene Name: Mdm1 nuclear protein
  ENST ID: ENST00000357874
  CDS Start-End: 1-92
tagtctccgggcttttcaaactctggcacgagctaagaaaaggaaggagaatttctgggatgaggaaactgaggtttacagaaactgagtaacttcgccaagtccatatccttcataaatggtgtagttggggctgcaagccatgcctaactggccttggagaccagattgctctgatgtttgaaggaagcttccatggctgttccggggtgtggcaggcgacctcacaaaacttgttctacatgttggccaaagatctgctaatttcctacttaggcaacattgtacaatccagttctaacaatattcttctttcctcctggcaaagctaaccatacggtcggaggacttgaatgcccagtgacgtttggtgacaatctgaagccaccaagg

SEQ ID NO: 152042 - DNA, 2718 bp, Homo sapiens
  Payload ID: 9929
  Gene Symbol: MDM1
  Gene Name: Mdm1 nuclear protein
  Uniprot ID: Q8TC05
  ENST ID: ENST00000393543
  CDS Start-End: 80-289
acactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtccgagtcttgtaattcctccgtggggcgaaagtacccatgggctggacttagatcagatcaattaggaaatcaaggcagatgtagaaccaagatccagcacagtgacatctcatcccttctcatcttggtctgctccacataagagaagctttgtgaaaagttccaaattttgacagtaccagggcccattgttctgttaagtagcacaggaaagtaattagaaacgaggcagcatgtactgcctggcctgccaggtctatcacgttgcaattctagtgacttttgttaggataactggaacattttgtgaccccctgatttttaattttttgttatggtcaaatttttaatgcttttaaaagcaaaattaaatattttatgttgaaaagctgtacttttaaaatcctataatctgaaggatattgtgtgtatatataggtacatatatctgaactaaatttaaaatttcatttctcctccacaagtgttcttaaaagttgtctttgtaactttttgctttagtagctactatttttgtataccgtgttttgtaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttactcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatggggtaggcatattcactgcatttcttttcaaaagcatagaattcttcattggtttcattgtcatttctgtaatattacattttgtgtttcagaattttccattgttgttttcttgtctaatgtctataagaatagttgataacaggctgttgactttagttattgtgaattagttctattctgactactcgctattttgtagtagttgtactatgataatctgtttattggatggacctcctgcgtctggattttattcatcatatattagcacctgagtcctaagggagagatcaagttgagacagagaagggaagtaggcccttacttctggcagggtgctgagctgacttctacctagccccttttcagtttcttatcgtgtacaagaagacaaacagaaattcaattgatgaaatgcaaaaggaaggagagctctggctgtctctcagagatcttgcatttctgctctcttatgtcacagctggcctgcagcaggtccctgtgagcacataagcagaggctgcaggaacttgtgtggggatctcaatgctttccacatttctttctccattctgttccactgctcttctctggttcatgtccaccactgactgggaccctgaagaggcatttcagagtgttggagaagaatctgtagcttgttgaaaaagctgggggtgaaagggaacaaggaaggtgatgtgtgagtctggcaggcaggagaaggggtgttcatagaagcagtgtgcaggtgaggcaaagtgctgggactttttggtaatagatttaattatgaatgattagtaggaaaggactgagagtattatatttttcctgggatgcctaatagtcctttgatagaaaggaattttaaatagtttgacacttgaaaaaagatactatttataagttgaagaaagtttgctgtaccacaatgcgcatgtagttaacaattttgcactgtagatttaacattttgttaagaggatagatttcatgttatgcattttttaccacaatttttaaaaagtttgaatagaaatttttaatgtctttgagtggattttgttttttgaacagttggatagacttctgcgtaagaaagctggattgactgttgttccttcatataatgccttgagaaattctgaatatcaaaggcagtttgtttggaagacttctaaagaaactgctccagcttttgcagccaatcaggtagcttaatggatgtaatacatttctgagtaccattatcttatctagtaatgtagatttacatagaattaagagttgaaagaaattaagtacttaagtagcctggaggtaggttctagaaaaccaaaatgagagttttgctaaaatcatcctattacttatgatttatggtagtaatattatactgtcctaggcttctgatgatcattgttgccagatgcagcacatatactaaatatgagacagggtaatgaaaacttggggaactggtaagtttttgcatgctacaagatttttttacttattaaaaaattattaaattgattttattctaaaatgttgtgttttgttgactaatatattgcgtgtttcctgtattctaagaaaggcgtaactgctttgaatatttaataaatacaaaatatgttgacagtaa

SEQ ID NO: 152043 - DNA, 2472 bp, Homo sapiens
  Payload ID: 9929
  Gene Symbol: MDM1
  Gene Name: Mdm1 nuclear protein
  Uniprot ID: Q8TC05
  ENST ID: ENST00000411698
  CDS Start-End: 42-2081
agttaactgtcggagtagcgggggctccggcgccgggcgacatgccggtgcgcttcaaggggctgagtgaataccagaggaacttcctgtggaaaaagtcttatttgtccgagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttactcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatggggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcagggttctctaaatgccatgtggtatgctgaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacgtgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacgttttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgt

SEQ ID NO: 152044 - DNA, 2170 bp, Homo sapiens
  Payload ID: 9929
  Gene Symbol: MDM1
  Gene Name: Mdm1 nuclear protein
  Uniprot ID: Q8TC05
  ENST ID: ENST00000430606
  CDS Start-End: 137-805
aagcgcggagtgcgccggcgcgtagtcggggacgccgggccgaggctttgctagggaacactgttatcgccccgccccctcggagctttttctccagttaactgtcggagtagcgggggctccggcgccgggcgacatgccggtgcgcttcaaggggctgagtgaataccagaggaacttcctgtggaaaaagtcttatttgtccgagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttactcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatggggtaggcatattcactgcatttcttttcaaaagcatagaattcttcattggtttcattgtcatttctgtaatattacattttgtgtttcagaattttccattgttgttttcttgtctaatgtctataagaatagttgataacaggctgttgactttagttattgtgaattagttctattctgactactcgctattttgtagtagttgtactatgataatctgtttattggatggacctcctgcgtctggattttattcatcatatattagcacctgagtcctaagggagagatcaagttgagacagagaagggaagtaggcccttacttctggcagggtgctgagctgacttctacctagccccttttcagtttcttatcgtgtacaagaagacaaacagaaattcaattgatgaaatgcaaaaggaaggagagctctggctgtctctcagagatcttgcatttctgctctcttatgtcacagctggcctgcagcaggtccctgtgagcacataagcagaggctgcaggaacttgtgtggggatctcaatgctttccacatttctttctccattctgttccactgctcttctctggttcatgtccaccactgactgggaccctgaagaggcatttcagagtgttggagaagaatctgtagcttgttgaaaaagctgggggtgaaagggaacaaggaaggtgatgtgtgagtctggcaggcaggagaaggggtgttcatagaagcagtgtgcaggtgaggcaaagtgctgggactttttggtaatagatttaattatgaatgattagtaggaaaggactgagagtattatatttttcctgggatgcctaatagtcctttgatagaaaggaattttaaatagtttgacacttgaaaaaagatactatttataagttgaagaaagtttgctgtaccacaatgcgcatgtagttaacaattttgcactgtagatttaacattttgttaagaggatagatttcatgttatgcattttttaccacaatttttaaaaagtttgaatagaaatttttaatgtctttgagtggattttgttttttgaacagttggatagacttctgcgtaagaaagctggattgactgttgttccttcatataatgccttgagaaattctgaatatcaaaggcagtttgtttggaagacttctaaagaaactgctccagcttttgcagccaatcaggtagcttaatggatgtaatacatttctgagtaccattatcttatctagtaatgtagatttacatagaattaagagttgaaagaaattaagtacttaagtagcctggaggtaggttctagaaaaccaaaatgagagttttgctaaaatcatcctattacttatgatttatggtagtaatattatactgtcctaggcttctgatgatcattgttgccagatgcagcacatatactaaatatgagacagggtaatgaaaacttggggaactggtaagtttttgcatgctacaagatttttttacttattaaaaaattattaaa

SEQ ID NO: 152045 - DNA, 2507 bp, Homo sapiens
  Payload ID: 9929
  Gene Symbol: MDM1
  Gene Name: Mdm1 nuclear protein
  ENST ID: ENST00000540418
  CDS Start-End: 42-182
agttaactgtcggagtagcgggggctccggcgccgggcgacatgccggtgcgcttcaaggggctgagtgaataccagaggaacttcctgtggaaaaagtcttatttgtccgagtcttgtaattcctccgtggggcgaaagtacccatgggctggacttagatcagatcaattagttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagacttacaccagcctaaaaggaagcttactccttggaaacatcaaaggcttgggaaggtgaattccgaatatagagcaaaatttctgagcccagctcagtatttatataaagctggggcttggacacatgtaaagggaaacatgccaaatcaggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctggagatcctacaagccataagactttgcagaaatgtccttctacagaaccagaagaaaaaggaaatatcgtggaagaacagccccagaaaaataccacggagaaattgggtgtgtcagctcccaccatacccgttagaaggcggctggcttgggatacagagaacacaagtgaagacgtacagaaacagcccggggagaaagaggaggaggacgacaatgaagaggaaggggacaggaaaacgggcaagcaggcttttatgggagagcaagagaagttggatgtacgtgagaaatctaaggcagataagatgaaagaagggtcagattcttctgtatcctcagaaaaaggaggccggcttcctactcccaagctgagagaacttggtggaatccagaggactcatcatgatctcactactccagctgttggtggtgctgttttagtgtctccatctaagatgaagcctccagccccagaacagaggaaaagaatgacctctcaggattgtttagaaacttcaaagaatgattttactaagaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacgttttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttctttttattttagttccttctatacatgtttgcagtgttaagataattgtactttgaaaacaccagctgtatatatttttcttatttatgtaacaaagtttgctgaaagatatgtatatttttgatctttgagtgtattctatttgtgtaaggactttggcttacatttgaataatgtctagattttgaaaaattacctgtataatggagaattaaaactttgtagacattttgaaataaaaatggatcaagtg

SEQ ID NO: 152046 - DNA, 805 bp, Homo sapiens
  Payload ID: 9929
  Gene Symbol: MDM1
  Gene Name: Mdm1 nuclear protein
  ENST ID: ENST00000539972
  CDS Start-End: 1-366
aaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttgagtgaagtttttcctaacgttttctactttgaaatatttaatttccaatagaacagtttacttggaaattgttaacataggcttatacaaatttaacttttaaagaattctttttacatctatcccagagtacaaagacctagattattgaattcttcacatgtaactttcgtaataggtgtcatggatagattttcacctatccagagagtattctaaaaaaataaacaaagtgaagtaaaagttaagatcccagtgtgaagtatatattcccctaagatttgatatatgtatctttataattgatgatgttgtaaaatgaatttgttgttcctttaacctttgctgtagtgtttcttttta

SEQ ID NO: 152047 - DNA, 874 bp, Homo sapiens
  Payload ID: 9929
  Gene Symbol: MDM1
  Gene Name: Mdm1 nuclear protein
  ENST ID: ENST00000541686
  CDS Start-End: 34-874
acatttgcaagctgcagtgtgtcgaagagtcagatggggctgagtgaataccagaggaacttcctgtggaaaaagtcttatttgtccgagtcttgtaattcctccgtggggcgaaagtacccatgggctggacttagatcagatcaattaggcatcacgaaagagccaagttttatttcaaaaagaagagtcccttaccatgacccacagatttcaaaatctctggagtggaatggagctatctcagagagcaatgtggttgcatcaccagaaccagaagccccggaaacaccaaaatcacaagaagcagaacaaaaggatgttactcaagaaagagttcactcactagaagcttccagggttcccaaaagaaccagatctcactctgcagactccagagctgaaggggcttcagatgtggaaaataatgagggtgtaacaaaccatacaccagttaatgaaaatgtggaactggaacattctaccaaggttctttcagaaaatgtagataatgggttggatagacttctgcgtaagaaagctggattgactgttgttccttcatataatgccttgagaaattctgaatatcaaaggcagtttgtttggaagacttctaaagaaactgctccagcttttgcagccaatcaggttttccacaataaaagccagtttgttccaccattcaaaggtaactcagtcatccatgaaactgaatacaaaagaaatttcaagggtttatctccagtgaaagaaccaaaattaagaaatgatttgagagaaaacagaaatcttgaaacagtgtctcctgaaaggaagagtaataaaatagacgatcgtttaaaattggaagcagagatggaattaaaagact

SEQ ID NO: 152048 - DNA, 3059 bp, Homo sapiens
  Payload ID: 9930
  Gene Symbol: MTBP
  Gene Name: MDM2 binding protein
  Uniprot ID: Q96DY7
  ENST ID: ENST00000305949
  CDS Start-End: 46-2760
gatgtggaagccgagacctaaagttggggggtgatctctgaggagatggatcggtacctgctgctggtgatctggggggaaggaaaattcccgtcggcggccagtagggaggcagaacatgggccagaggtgtcgtcgggtgagggtactgagaatcagccggacttcacagcagcaaatgtttatcacctcttgaaaagaagcattagtgcttcaattaatccagaagatagtactttccctgcctgttcagtgggaggtatacctggttccaagaagtggttctttgcagtgcaggcaatatatggattttatcagttttgtagttctgattggcaagagatacattttgatacagaaaaagataaaattgaagatgttcttcaaacgaatatcgaagaatgtttgggtgctgttgagtgttttgaagaagaagacagtaatagcagggaatcattatccttggctgatctctatgaagaagctgcagaaaatttgcatcagctgtcagacaagcttcctgctcctggtagagcaatggtagatataatactgttgctttctgacaaagatcctcctaaattgaaagactatttacctactgtaggagcattaaaacatttgagagaatggtattcagcaaagatcactatagcaggaaatcattgtgaaataaactgtcagaaaattgcagaatacctttctgctaatgttgtatctttagaagatctcagaaatgttattgactcaaaggaattatggagggggaaaatacagatatgggaaagaaagtttggatttgaaattagttttcctgaattttgtttaaagggagtcacacttaagaattttagtacttctaatttaaatactgacttccttgccaaaaagatcataccatcaaaggataagaatattttgccaaaggttttccattattatggccctgctttagaatttgtgcagatgataaaattatcagatctaccctcctgctatatgtcggatattgaatttgagttaggattgacaaacagtaccaaacagaattctgtgttgctgttggagcagatttcttctctgtgtagcaaggttggtgctctttttgtattgccatgtaccattagtaacatactgattccacctcccaaccaactcagttcaagaaaatggaaggaatatatagctaaaaagcctaaaacaatcagtgttccagatgttgaagtgaaaggagagtgttctagctattatctcttgttacaaggtaatggcaatagaagatgtaaagccacattgattcactcagccaaccagatcaatggctcatttgcactcaatttaattcatggaaagatgaaaacaaagacagaagaagccaaattgagttttccttttgacttattatcacttccacatttttctggggagcagattgtacagagagagaaacagttagctaatgttcaagttttagctttggaagaatgcctaaaaagacgaaagttggcaaagcagcctgaaacagtttctgttgctgaactcaaaagtctgttagtactcacaaggaaacactttttagattattttgatgctgtgattcctaaaatgattctaagaaagatggacaaaattaaaaccttcaatatattaaatgattttagtccagtggaacctaattcctcaagtctaatggaaaccaatcctctggaatggccagaaaggcatgttcttcaaaatttggaaacttttgaaaaaactaaacaaaaaatgagaactggttcattacctcattcatctgaacagttgctgggccacaaagagggtcctcgggactcaatcacattgttggatgctaaagaattgctgaagtactttacctcagatggattacccattggagatcttcaacctttaccgattcaaaagggggaaaagacttttgttttgacaccagaacttagtcctgggaaacttcaggtcttaccttttgagaaagcctcagtatgtcattatcatggaattgaatattgcttggatgaccgaaaagctttggaaagagatggaggattttctgaacttcagtctcgtcttattcgttatgaaactcaaactacctgcaccagagaaagttttccagtacctactgtgttgagccctcttccatctcctgtagtttcgtcagatcctggaagtgtccctgacggagaagttttacaaaatgaacttcgaactgaagtatcccgattgaaacggagatctaaagatctgaattgcctttatcccagaaaaagacttgtgaaatctgaaagttcagagtctcttctttctcagacaactggtaatagtaatcactatcatcatcatgtgacatccagaaagccacaaacagaacggtccttaccagtgacttgtccattggttccaattcctagctgtgaaactccaaaacttgctacaaagaccagttcaggtcaaaaaagtatgcatgaatcaaaaacatcaaggcaaattaaggaatcaagatcacagaaacacacacggatactgaaagaagtagttactgaaaccctgaagaaacacagtattaccgagactcatgaatgtttcactgcatgcagccagcgtctctttgaaatctctaagttctatctaaaggatcttaaaacttcaaggggtctatttgaagaaatgaagaaaacagcaaacaacaatgctgtacaggtgattgactgggtattagaaaagacaagcaagaaatgatacataatcattctctttaagacaattataaattggatggagctattattcactacttcttttcttagtttgaaaattataaacaaattttaagctttattcaaagaatagatgttatatttctaaagaatttcatgaatatatattctatatttgtatagtttgagggatgctatgttaatgtatttttaattagatacatattttgtaaagtgttactatattttaaagttatttttatatgttttaaaatgtttactcttatttaattattacaataaacagaatttttttttttt

SEQ ID NO: 152049 - DNA, 467 bp, Homo sapiens
  Payload ID: 9930
  Gene Symbol: MTBP
  Gene Name: MDM2 binding protein
  ENST ID: ENST00000519556
  CDS Start-End: 1-202
gatactgaaagaagtagttactgaaaccctgaagaaacacagtattaccgagactcatgaatgtttcactgcatgcagccagcgtctctttgaaatctctaagttctatctaaaggatcttaaaacttcaaggggtctatttgaagaaatgaagaaaacagcaaacaacaatgctgtacagggtatcccttgtagttgctgaaactgacagaggagtctgggacagttacatacgactcttgagagctaaagctgactgtagcacgctacatctggtgcgctgctcactacagatggtgtctgacatcacgttctctggtggcattgcagcccttcttttctcaaagcatcctgattccatcatctgaagacattttgagcttttcataaggagactgtatgatggtcttgggaaaggcaccctcctgtggttcagtggtaatagaaaatccattctcataatgtat

SEQ ID NO: 152050 - DNA, 1219 bp, Homo sapiens
  Payload ID: 9930
  Gene Symbol: MTBP
  Gene Name: MDM2 binding protein
  Uniprot ID: Q96DY7
  ENST ID: ENST00000523373
  CDS Start-End: 50-1039
tttggatgtggaagccgagacctaaagttggggggtgatctctgaggagatggatcggtacctgctgctggtgatctggggggaaggaaaattcccgtcggcggccagtagggaggcagaacatgggccagaggtgtcgtcgggtgagggtactgagaatcagccggacttcacagcagcaaatgtttatcacctcttgaaaagaagcattagtgcttcaattaatccagaagatagtactttccctgcctgttcagtgggaggtatacctggttccaagaagtggttctttgcagtgcaggcaatatatggattttatcagttttgtagttctgattggcaagagatacattttgatacagaaaaagataaaattgaagatgttcttcaaacgaatatcgaagaatgtttgggtgctgttgagtgttttgaagaagaagacagtaatagcagggaatcattatccttggctgatctctatgaagaagctgcagaaaatttgcatcagctgtcagacaagcttcctgctcctggtagagcaatggtagatataatactgttgctttctgacaaagatcctcctaaattgaaagactatttacctactgtaggagcattaaaacatttgagagaatggtattcagcaaagatcactatagcaggaaatcattgtgaaataaactgtcagaaaattgcagaatacctttctgctaatgttgtatctttagaagatctcagaaatgttattgactcaaaggaattatggagggggaaaatacagatatgggaaagaaagtttggatttgaaattagttttcctgaattttgtttaaagggagtcacacttaagaattttagtacttctaatttaaatactgacttccttgccaaaaagatcataccatcaaaggataagaatattttgccaaaggttttccattattatggccctgctttagaatttgtgcagatgataaaattatcagatctaccctcctgctatatgtcggatattgaatttgagtttacagaggattgacaaacagtaccaaacagaattctgtgttgctgttggagcagatttcttctctgtgtagcaaggttggtgctctttttgtattgccatgtaccattagtaacatactgattccacctcccaaccaactcagttcaagaaaatggaaggaatatatagctaaaaagcctaaaacaatcagtg

SEQ ID NO: 152051 - DNA, 1361 bp, Homo sapiens
  Payload ID: 9931
  Gene Symbol: MDM2
  Gene Name: MDM2 proto-oncogene, E3 ubiquitin protein ligase
  ENST ID: ENST00000258148
  CDS Start-End: 15-1343
cgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagag

SEQ ID NO: 152052 - DNA, 12633 bp, Homo sapiens
  Payload ID: 9931
  Gene Symbol: MDM2
  Gene Name: MDM2 proto-oncogene, E3 ubiquitin protein ligase
  Uniprot ID: Q00987
  ENST ID: ENST00000258149
  CDS Start-End: 303-1796
ggggcgcgcaccgaggcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagctctcctttaaagactttaaaaaaaattcgataggcattttcatgtttcagtcctacaatcccacatctctgctgccttcagaatgctacaacttagatgtccagccaacagcttaaagccaatttataaaaatagcatctttcctaattccaaaatttcaccttttgtttgttttgttttgagatgcggtcttgctctgtcgcccaggctggaatgcagtgctgcaaacatgactcactacagcctcaacctcctgggctcaagcaatcctcccacctcagcctcccaagtagctggggaccacaggtgcaagccaccaggtccagctaaccttccccccacctcccccgaccccgctgccacccgccctgagacagagtcttgctctttcacccagactggagtgcagtggtgcaatctcggctcattgcaacctccacctcccaggttcaagcaattctgcctcagcctcctgagtagctggaattataggtgctcgccaaccacacctggctaattttttttgtatttttagtagagatggggtttcagcatgttgtccaggctggtctcgaactcctgacctcatgatccgcccacctcggcctcccaaagtactgggattacaggcgtgagccaccgtgcccggcctaatttttgtattttttgtagagacagtttcaccatgttgcccaggctggtctcaaactcctggggtcaagtgatctgcccgtcttggcttcccaaagtgctgagattacaggtgtaagccaccacgccaagcccaaaatttcaccttttaaatttattccatttattttgtaggtgaatttcatttatttctcagggttaaattttagcgcttttgcctgtgtctatttttggttcacacctccccagcccactgtcctgtattaagtaggccttccttcaagatcacagtaatatctccctaaatggatttcactacgtttggtcctatttttggttcagttatagtttacagataccatcatgttgcttccctgatttaaatattgggggaaaaacttgctttttggattttatctctgatgttctactggattattttagacttttagaacactatgaaatgggtgcttgcttttcacttttcaaaccttttttgcttaaacaaagttcataagcttattgtagtgggaagttcaaagtcacagatctggtacttactcgcctagtgaccttagagacaataaatctatagagcctagtatggggtctggcaggtagtaagcacttttaatgaatggaagtttaatattctgtttgcatccactcgaccataatcaccccaaatccagcttaggtagccttgaattaacccctactccaccttgaagttttttatttgttttttgctgagacagggtctcattctgtcacccaggctggagtatagtggcgcaaacatgactcactgcagcctcctgagtagctgggaacacaggcctgttgccaccatgcctggctaatatatatattatatataatatacatatattacatatatatatataatacatatgtgtttatgtatgtatgtgtgtgtacattatatatatatatatactttttttagaggcagagtcctgctatgttgcccaggctggccttgaactcctgggctcaagcaatcctcgtgtcttgaccttgacctctcaaaatgctgggattacaggtgcgagccactgcatctggtgaattaagccttttttatacactcaactctgaggtattctgttcataccaatatgttcctttgtatcttcttgccatagcaggttgtaacatccttttgtatctcctttctttttttttttttttttttgagacggagtcccgctgtttagcccaggccggattgcagtggcgcaatctcggctcactgcaagctccgcctcccaggttcacgccattctcctgcctcagcctcccgagtagctgggactacaggcgcccgccaccgcgcctggctaattttttgtatttttagtagagacggggtttcaccgtgttagccaagatggtctcgatctcctgaccttgtgatccgcccgcctcggcctcccaaagtgctgggattacaggcgtgagccaccgcgcccagccgtatctcctttcaaatgtcaaataaatacattgtgtatacagtagtaaaggatgttgattggcattgaaagcaactatcaagttcttgttgatttagaagacaaaaagacaattttaaaataacatcctgggccaggctctgtgactcacgcctgtaatctcaacactttgggaggccaaggaaggaggatcacttgaggccaggagtttgagatcagcctgggcaacataatgacaccctgtatccaaaaaattgtggtggcatgcatgggagactgaggtgggaggatcacttgagcccaggagtccaatgttacaatgagctatgattgcgccactacactctgcttaggagacagatggagacttgtctcttaaaaaaataaaaaataacagtatgttcattaaacattaatctcactgattgtgattttttgtttgtttttttgagatggcgtcttgctctgttgcccagggtggagtgcaatggcgtgatcttggctcactgcagcctccacctcctgggttcaagtgattctcctgctttagcctcccaagtagctgtgttatttcagctaattttttcatttttagtggagatggggttttgccatgttggccaggctggtctcgaattcctgacctcatgtggtccacctgcctcggcctcccaaagtgctgggattacaggcattgagccactgtgcctggcctgattatgattttttaaagtccccccccaaattattgtttgtgcaataaatggcaaaaaagaagcattctaagaaaaaagtagtcttaaaagttgatatggtgtcagaattgtaagagagagggtcttggctgaaaagcctttttagaaaaaattgctccctacaaaaaaggccttttctaccttttctcacatttgtttctttttataggaggcatctgagaagaccaaatctcttcaaagttaagctttttgtttttttgggggggacgaagtctcgttctgtcacccaggctggagtgtagtggcatgatctcggctcactgcaacctctgcctcctgggttcaagcaattctcctgcctcagcctcccgagtagctggaaattcaggcgcctgccaccatgcccagctaatttttgtatttttaatagaggcagggtttcactatattggccaggctggtctcgaactcctgacctcatgatccgcctgcctctgcctcccaaagtgttgggattacaggcatgagccaccgcacccagcccaaagttaagcattttttaaccacaaggtgggaggtggaagtatctcgttggaagactaaaggtgtccactaacggtagacccttttttttttttttttgagatggagtttcactgtcgcccagactagactgaagtggcgcgatctcggctcactgcaacctctgccccccaggttcaagtgattctcctgcctcagcctctagagtagctaggattacaggggtccaccaccacacctggctagtttttgtattttcagtagagacggggtttcaccatgttggccaggctggtctcgaactcctgacctcaggtgacccacctgctttggcctcccaaagtgctgggattacaggtgtgagccactgcgcctggccgtttttttttttgttgttgttgttgtttgttcgtttgtttgttttgagacagtctctcactccaggttggagtgcagtggcactatctcagctcactgcaaactctgcctcccaaggtcaaatgattctcctgcctcagcctcccagtagttggaattacaggcgcatgccaccatgcatggctaattttttgtatttttagtagagacggggtttcaccatgctagccttgaactcctgaccttgtgatctgcctgcctcggcctcccaaagtgctgggattacagacatgagccaccatgctagccttgaactcctgacctcgtgatctgcctgcctcggcctcccaaagtgctgggattacagacatgagccaccatgcctggcaaatttttgtattttcagtagagatggggttttgctatgttagccaggctagtctcgaactcctgacctcaggtgatccagtcgcctcggcctcccaaagtgctgggattacagatgtgagtcactacgcttggtagactcttaacagcgctgagagaccactccaagagagcagagaaataatagttctattctcagttgtcaaacagcaaacaaaaaacccttggctggggggtgatggctcacccctgtaatcccagcactttgggaggctgaggtgggtggatcacttgaggccaggaattcaagaccaacctgggcaacatggtgcaaccctgtcttaactaaaaatacaaaaattagccaggcgtcatggcatgtgcctgttaattccagctgctcgagaggctgaggcatgagaattacttgaacctgggaggtggaggttgcagtgagccgagatcccaccactgcactccagcctgggtgacagagcgagacttcgtcccaaaaaaaaaaaaaaaagctgcaaatttaaacgttgaagtctaggtaaatataccagggaacttctgcttaagaggcttctatgtaatgaaattctcttgaaaacagagaaactatttcctgtttattttctaaattgagacgtcactttttaaaaattggtacctgtaatttagccatttcctactcagcaatgtctcatttaaactattatttgtttagcgtgtttcaaagagcagatgtaagcttgagcccatcctctgtcctatgactaagtcgatattagcaggggttaggactgttagttttccagttcctactggaggcaaattctttgtttaccactgttctctgtatttcaaaagcacctggaaatcaataaaatttgttattcagaacaaaa

SEQ ID NO: 152053 - DNA, 1401 bp, Homo sapiens
  Payload ID: 9931
  Gene Symbol: MDM2
  Gene Name: MDM2 proto-oncogene, E3 ubiquitin protein ligase
  ENST ID: ENST00000350057
  CDS Start-End: 1-1401
atgtgcaataccaacatgtctgtacctactgatggtgctgtaaccacctcacagattccagcttcggaacaagagaccctggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152054 - DNA, 966 bp, Homo sapiens
  Payload ID: 9931
  Gene Symbol: MDM2
  Gene Name: MDM2 proto-oncogene, E3 ubiquitin protein ligase
  Uniprot ID: Q00987
  ENST ID: ENST00000299252
  CDS Start-End: 1-966
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152055 - DNA, 1583 bp, Homo sapiens
  Payload ID: 9931
  Gene Symbol: MDM2
  Gene Name: MDM2 proto-oncogene, E3 ubiquitin protein ligase
  ENST ID: ENST00000311420
  CDS Start-End: 206-460
gcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagag

SEQ ID NO: 152056 - DNA, 798 bp, Homo sapiens
  Payload ID: 9931
  Gene Symbol: MDM2
  Gene Name: MDM2 proto-oncogene, E3 ubiquitin protein ligase
  ENST ID: ENST00000348801
  CDS Start-End: 1-798
atgtctgtacctactgatggtgctgtaaccacctcacagattccagcttcggaacaagagaccctggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152057 - DNA, 6735 bp, Homo sapiens
  Payload ID: 9931
  Gene Symbol: MDM2
  Gene Name: MDM2 proto-oncogene, E3 ubiquitin protein ligase
  Uniprot ID: Q00987
  ENST ID: ENST00000356290
  CDS Start-End: 75-1040
tgtgttcagtggcgattggagggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtct

SEQ ID NO: 152058 - DNA, 891 bp, Homo sapiens
  Payload ID: 9931
  Gene Symbol: MDM2
  Gene Name: MDM2 proto-oncogene, E3 ubiquitin protein ligase
  Uniprot ID: Q00987
  ENST ID: ENST00000360430
  CDS Start-End: 1-891
atgtgcaataccaacatgtctgtacctactgatggtgctgtaaccacctcacagattccagcttcggaacaagagaccctggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152059 - DNA, 732 bp, Homo sapiens
  Payload ID: 9931
  Gene Symbol: MDM2
  Gene Name: MDM2 proto-oncogene, E3 ubiquitin protein ligase
  ENST ID: ENST00000393410
  CDS Start-End: 1-732
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152060 - DNA, 1404 bp, Homo sapiens
  Payload ID: 9931
  Gene Symbol: MDM2
  Gene Name: MDM2 proto-oncogene, E3 ubiquitin protein ligase
  ENST ID: ENST00000393412
  CDS Start-End: 306-1037
gcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggc

SEQ ID NO: 152061 - DNA, 657 bp, Homo sapiens
  Payload ID: 9931
  Gene Symbol: MDM2
  Gene Name: MDM2 proto-oncogene, E3 ubiquitin protein ligase
  Uniprot ID: Q00987
  ENST ID: ENST00000393413
  CDS Start-End: 1-657
atgtgcaataccaacatgtctgtacctactgatggtgctgtaaccacctcacagattccagcttcggaacaagagaccctggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152062 - DNA, 842 bp, Homo sapiens
  Payload ID: 9931
  Gene Symbol: MDM2
  Gene Name: MDM2 proto-oncogene, E3 ubiquitin protein ligase
  ENST ID: ENST00000393415
  CDS Start-End: 75-842
tgtgttcagtggcgattggagggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtatatcaagttactgtgtatcaggcaggggagagtgatacagattcatttgaagaagatcctgaaatttccttagctgactattgg

SEQ ID NO: 152063 - DNA, 754 bp, Homo sapiens
  Payload ID: 9931
  Gene Symbol: MDM2
  Gene Name: MDM2 proto-oncogene, E3 ubiquitin protein ligase
  ENST ID: ENST00000393416
  CDS Start-End: 68-754
agtggcgattggagggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagagagatggagtttcactatgttgcccaggctggtctggaactcctgggctcaagggatctgcttacctcggcctcctaaagtgctagatttacaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggct

SEQ ID NO: 152064 - DNA, 1037 bp, Homo sapiens
  Payload ID: 9931
  Gene Symbol: MDM2
  Gene Name: MDM2 proto-oncogene, E3 ubiquitin protein ligase
  ENST ID: ENST00000428863
  CDS Start-End: 306-1037
gcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152065 - DNA, 7420 bp, Homo sapiens
  Payload ID: 9931
  Gene Symbol: MDM2
  Gene Name: MDM2 proto-oncogene, E3 ubiquitin protein ligase
  ENST ID: ENST00000462284
  CDS Start-End: 325-1725
gtagggggcgcgcaccgaggcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtct

SEQ ID NO: 152066 - DNA, 505 bp, Homo sapiens
  Payload ID: 9931
  Gene Symbol: MDM2
  Gene Name: MDM2 proto-oncogene, E3 ubiquitin protein ligase
  ENST ID: ENST00000523991
  CDS Start-End: 75-505
tgtgttcagtggcgattggagggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatccccc

SEQ ID NO: 152067 - DNA, 1683 bp, Homo sapiens
  Payload ID: 9931
  Gene Symbol: MDM2
  Gene Name: MDM2 proto-oncogene, E3 ubiquitin protein ligase
  ENST ID: ENST00000393417
  CDS Start-End: 114-326
gatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggacttcttgggcatccctggatcccaggttaagaacttctgcactagagatacatgagtacagtatactgatctttctgggatagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacct

SEQ ID NO: 152068 - DNA, 897 bp, Homo sapiens
  Payload ID: 9931
  Gene Symbol: MDM2
  Gene Name: MDM2 proto-oncogene, E3 ubiquitin protein ligase
  ENST ID: ENST00000496959
  CDS Start-End: 1-183
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagagaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152069 - DNA, 393 bp, Homo sapiens
  Payload ID: 9931
  Gene Symbol: MDM2
  Gene Name: MDM2 proto-oncogene, E3 ubiquitin protein ligase
  ENST ID: ENST00000517852
  CDS Start-End: 1-393
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152070 - DNA, 692 bp, Homo sapiens
  Payload ID: 9931
  Gene Symbol: MDM2
  Gene Name: MDM2 proto-oncogene, E3 ubiquitin protein ligase
  ENST ID: ENST00000478070
  CDS Start-End: 1-150
atgtctgtacctactgatggtgctgtaaccacctcacagattccagcttcggaacaagagaccctggaaaatatataccatgatctacaggaacttggtagtagtcaatcagcagggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152071 - DNA, 1056 bp, Homo sapiens
  Payload ID: 9931
  Gene Symbol: MDM2
  Gene Name: MDM2 proto-oncogene, E3 ubiquitin protein ligase
  ENST ID: ENST00000481186
  CDS Start-End: 1-108
atgtgcaataccaacatgtctgtacctactgatggtgctgtaaccacctcacagattccagcttcggaacaagagaccctgaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152072 - DNA, 427 bp, Homo sapiens
  Payload ID: 9931
  Gene Symbol: MDM2
  Gene Name: MDM2 proto-oncogene, E3 ubiquitin protein ligase
  ENST ID: ENST00000543323
  CDS Start-End: 75-427
tgtgttcagtggcgattggagggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggactattggaaatgcacttcatgcaatgaaatgaatccccc

SEQ ID NO: 152073 - DNA, 213 bp, Homo sapiens
  Payload ID: 9931
  Gene Symbol: MDM2
  Gene Name: MDM2 proto-oncogene, E3 ubiquitin protein ligase
  ENST ID: ENST00000544561
  CDS Start-End: 1-213
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgtgcaaagaagctaaagaaaaggaataa

SEQ ID NO: 152074 - DNA, 1011 bp, Homo sapiens
  Payload ID: 9931
  Gene Symbol: MDM2
  Gene Name: MDM2 proto-oncogene, E3 ubiquitin protein ligase
  ENST ID: ENST00000537182
  CDS Start-End: 1-237
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggaaaatatataccatgatctacaggaacttggtagtagtcaatcagcaggaatcatcggactcaggtacatctgtgagtgagaacaggtgtcaccttgaaggtgggagtgatcaaaagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152075 - DNA, 1181 bp, Homo sapiens
  Payload ID: 9931
  Gene Symbol: MDM2
  Gene Name: MDM2 proto-oncogene, E3 ubiquitin protein ligase
  ENST ID: ENST00000536089
  CDS Start-End: 1-237
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152076 - DNA, 845 bp, Homo sapiens
  Payload ID: 9931
  Gene Symbol: MDM2
  Gene Name: MDM2 proto-oncogene, E3 ubiquitin protein ligase
  ENST ID: ENST00000539479
  CDS Start-End: 75-845
tgtgttcagtggcgattggagggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaa

SEQ ID NO: 152077 - DNA, 1127 bp, Homo sapiens
  Payload ID: 9931
  Gene Symbol: MDM2
  Gene Name: MDM2 proto-oncogene, E3 ubiquitin protein ligase
  ENST ID: ENST00000542502
  CDS Start-End: 1-255
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152078 - DNA, 398 bp, Homo sapiens
  Payload ID: 9931
  Gene Symbol: MDM2
  Gene Name: MDM2 proto-oncogene, E3 ubiquitin protein ligase
  ENST ID: ENST00000545204
  CDS Start-End: 1-156
atgtgcaataccaacatgtctgtacctactgatggtgctgtaaccacctcacagattccagcttcggaacaagagaccctggttagtaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152079 - DNA, 1315 bp, Homo sapiens
  Payload ID: 9931
  Gene Symbol: MDM2
  Gene Name: MDM2 proto-oncogene, E3 ubiquitin protein ligase
  ENST ID: ENST00000540352
  CDS Start-End: 1-513
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 152080 - DNA, 363 bp, Homo sapiens
  Payload ID: 9931
  Gene Symbol: MDM2
  Gene Name: MDM2 proto-oncogene, E3 ubiquitin protein ligase
  ENST ID: ENST00000546048
  CDS Start-End: 1-237
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagactaaagaaaaggaataagccctgcccagtatgtagacaaccaattcaaatgattgtgctaacttatttcccctag

SEQ ID NO: 152081 - DNA, 697 bp, Homo sapiens
  Payload ID: 9932
  Gene Symbol: MDM4
  Gene Name: MDM4, p53 regulator
  ENST ID: ENST00000367179
  CDS Start-End: 58-697
ggggaaactttatagtcatcttggtacgtggcgagggtttcatatgttttctgaattatgcctaattttgtagtagactggagggtttatacagatagcctgtttttaacagtagattttggcctttgtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaagg

SEQ ID NO: 152082 - DNA, 547 bp, Homo sapiens
  Payload ID: 9932
  Gene Symbol: MDM4
  Gene Name: MDM4, p53 regulator
  ENST ID: ENST00000367180
  CDS Start-End: 30-425
caacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagaaatgggtcatttgttctgtagaatttcccacgctctagagttggcagattaatgtcgctttagatgaagatgctattgttttatgaagcaaacggggaaaaatccagatttcaagatcccataaccctgtatgacttaacacttgaaagttgaaattaaatgtaaaaagccata

SEQ ID NO: 152083 - DNA, 10073 bp, Homo sapiens
  Payload ID: 9932
  Gene Symbol: MDM4
  Gene Name: MDM4, p53 regulator
  Uniprot ID: O15151
  ENST ID: ENST00000367182
  CDS Start-End: 163-1635
gggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagatgctgctcagactctcgctctcgcacaggatcacagtatggatattccaagtcaagaccaactgaagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattccgttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttctgtcaccccaaaacactcccttctgcccctcttcagacagtccttcagctatttcatggctctcaccctagttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagtttttttttttttttgagagacggtctcactttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgtcgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctctttttttttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaaaaaaaaaaaaatcgtggaccgggcgtagtggctcacgcctgtaatcccaacactttgggagatcacctaggtcgggagtttgagaccagcctgaccgacatggagaaaccccatttttactaaaaatacaaaaaattagctgggcatggtggtgcatgcctgtagtcccagctactcaggaggctgaggcaggagaatcgcttgaacctgagagggggagattgcggtgagctgagattgcgccattgcaccccagcctgggcaacaatagcgaaactgtctcagaaaaaagaaaaaaaaaatcgcaaaaagaaaaatctcataatgtcgttgttggtttttttttttttttttgagacagtctcactctgttgcccaggctggagtgcaatggcatgatctctgctcaccgcaacctctgcctcccgggttcaggtgattctcctgcctcagcctcccagatagctgggactacaggcacataccaccatgcctggctaatttttgtatttttagtagagatgggggtttcactgtgttggccaggctggtctcgaactcctgacctcatgatccacacacctcggcctcccaaagtcctgcgattacaggcgtgagctaccgcacccagccaagttgtaatttttaataaaacttaagaagtaaacattttacttatgtttataggtatttgatcctaaatttgacacatcattgcccatgaaagaatcctcttaggctgctcagcttcactcttcctgcttgcccaccggggtttttcactgcttctgttagcactaagtacttagacgatcctaagatatgtgcttgagccgaatttcatctttacttgtaggaaactttaaactatttcttttcttttcttttttttttttttttacttgagatggagttttgctcttgtcgcccaggctggagtgcagtggagtgatctcggctcactgcaacctctgcctcccgggttcaaatgattctcctgcctcagcctcccaagtagctgggattacaggtgtgcaccaccatgtctggctaattttgtatttttagtagagatggtttcaccatgttggtcaggctggtctcgaactcctgacctcaggtcatccacccacctcagcctcgcaaagtgctgagattacaggcatgagccacagcgcccagcttaaactattttcttggtctgtttttgattttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgttacctcttgactcgcttttgaaaggaagacaattgttaactagatatttgagttttttcccctcagaattatgtgaatttctgatatatggctttagatactgtgaatctgttttccatttagtcagttatctgcttaaattgttcagaactatatcctaacgagcaattagttctgatggttctcccagtcatgagtgtgcatgtgtgcaagcatgttttgatcctgatgctacctttgctaaaaatggccatagattaggaactagctatgtttttagaatcaaagatgaaccggtaagctgtctcatgtaccaaacgtgaaatttacagtgtttacaaatgtctggaattttgcactgccatagggaatgttaaggttacttggctggaatttatcagacttgtgagtaaacaagttgaagtttagcagatgagggggaatattgaggcccctaaggctaaacaaaataatcagtatctgagatagtggctaatgtggctccccaggcctaatttgggaacagtttttcctgattgctttgagaagtactttcttttgacagaaattttcattctgcttgccattgctatattctccctttataggagccattggatttctttccttttgtgggaaatgtcccattagcattttcagatcttttgatgtgcactaatgccattattggtaatgccgttattggtgaatacagcatagttaaataaactgttacagtaaatctacacttggatttgctgcacctctaccaatagccttttgaatgactgaaagtgttaacagagaaagaggcatgtctgcagaaagagatagctaatattttttggtactttatctgaaatccaagatgctgcttcccctgcaggttgttttccttcttacgatcctcattgaatcccctctgggagcacaggacagttagtagaactctccatttctttttttttttttttagacggagtctctctctgtcgccccggctggagtgcagtggcgcgatctcggctcactgcaacctccgcctcccgggttcaccccattctcctgcctcagcctccctagtagctgggactataggcgcccgccaccacgcctggctaatttttgtatttttattggagacggggtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgatattaggctaggggcggtggcttacgcctgtaatcccagcactttgggaggccgaggtgggtggattgcctgagctcaggagttcgagaccagtctgaccagtatggtgaaaccctgtctctactaaaaatacaaaaattagccggtcgtggtggcgtgcacctgtagtcccagctacttggcaggttgagacaggagaatcgcttgaacctgggaggtggaggttgcagtgagccgagactgcaccactgcgctcccacctgggtgacagagactctgtctcaaaaaaaaggacatttatcattataacatcttattagagcccctaatttcttatctgaaggcactgtttttttttttaaacagttaagtactgatgtcaacagacaaatatttctgatcagatagtcccctgtcaacagtagcaaatgtggtttcataaagtgggaagaaaacagcattttaaagtaactttttgggagactgatttgagtaataataaaactctggtctcccttaagaaaaaaaaacccttccacctttactgtgtcatttatatccccttagttccaaagttaattatcttatttctggatattgcttttataccaaagacccttatcagcccttgtaactacagtatctttagataagattcctctttccagtcagtcctgggaaatgtttctgttgcagagttaggcggtagatgggaagctgtgatggcagagctactatctaataaagtaacaactcgtagttgaggcttcctttctgtgtgtgatgggggatagggagttagctcccctgttgtctcagcactaagaaattgaggtcaggccaggcgcggtggttcactcctgttattccagcactggggtggccaaagtgggcagattgcttgcgctctggagctcgagaccagcctgggcaacatggtgaaaccctgtctctaccaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtagctgggactacaggcgtgcaccaccacacctggctaattttgtatttttagtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataacaacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgcca

SEQ ID NO: 152084 - DNA, 9098 bp, Homo sapiens
  Payload ID: 9932
  Gene Symbol: MDM4
  Gene Name: MDM4, p53 regulator
  Uniprot ID: O15151
  ENST ID: ENST00000367183
  CDS Start-End: 167-661
gtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattccgttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttctgtcaccccaaaacactcccttctgcccctcttcagacagtccttcagctatttcatggctctcaccctagttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagtttttttttttttttgagagacggtctcactttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgtcgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctctttttttttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaaaaaaaaaaaaatcgtggaccgggcgtagtggctcacgcctgtaatcccaacactttgggagatcacctaggtcgggagtttgagaccagcctgaccgacatggagaaaccccatttttactaaaaatacaaaaaattagctgggcatggtggtgcatgcctgtagtcccagctactcaggaggctgaggcaggagaatcgcttgaacctgagagggggagattgcggtgagctgagattgcgccattgcaccccagcctgggcaacaatagcgaaactgtctcagaaaaaagaaaaaaaaaatcgcaaaaagaaaaatctcataatgtcgttgttggtttttttttttttttttgagacagtctcactctgttgcccaggctggagtgcaatggcatgatctctgctcaccgcaacctctgcctcccgggttcaggtgattctcctgcctcagcctcccagatagctgggactacaggcacataccaccatgcctggctaatttttgtatttttagtagagatgggggtttcactgtgttggccaggctggtctcgaactcctgacctcatgatccacacacctcggcctcccaaagtcctgcgattacaggcgtgagctaccgcacccagccaagttgtaatttttaataaaacttaagaagtaaacattttacttatgtttataggtatttgatcctaaatttgacacatcattgcccatgaaagaatcctcttaggctgctcagcttcactcttcctgcttgcccaccggggtttttcactgcttctgttagcactaagtacttagacgatcctaagatatgtgcttgagccgaatttcatctttacttgtaggaaactttaaactatttcttttcttttcttttttttttttttttacttgagatggagttttgctcttgtcgcccaggctggagtgcagtggagtgatctcggctcactgcaacctctgcctcccgggttcaaatgattctcctgcctcagcctcccaagtagctgggattacaggtgtgcaccaccatgtctggctaattttgtatttttagtagagatggtttcaccatgttggtcaggctggtctcgaactcctgacctcaggtcatccacccacctcagcctcgcaaagtgctgagattacaggcatgagccacagcgcccagcttaaactattttcttggtctgtttttgattttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgttacctcttgactcgcttttgaaaggaagacaattgttaactagatatttgagttttttcccctcagaattatgtgaatttctgatatatggctttagatactgtgaatctgttttccatttagtcagttatctgcttaaattgttcagaactatatcctaacgagcaattagttctgatggttctcccagtcatgagtgtgcatgtgtgcaagcatgttttgatcctgatgctacctttgctaaaaatggccatagattaggaactagctatgtttttagaatcaaagatgaaccggtaagctgtctcatgtaccaaacgtgaaatttacagtgtttacaaatgtctggaattttgcactgccatagggaatgttaaggttacttggctggaatttatcagacttgtgagtaaacaagttgaagtttagcagatgagggggaatattgaggcccctaaggctaaacaaaataatcagtatctgagatagtggctaatgtggctccccaggcctaatttgggaacagtttttcctgattgctttgagaagtactttcttttgacagaaattttcattctgcttgccattgctatattctccctttataggagccattggatttctttccttttgtgggaaatgtcccattagcattttcagatcttttgatgtgcactaatgccattattggtaatgccgttattggtgaatacagcatagttaaataaactgttacagtaaatctacacttggatttgctgcacctctaccaatagccttttgaatgactgaaagtgttaacagagaaagaggcatgtctgcagaaagagatagctaatattttttggtactttatctgaaatccaagatgctgcttcccctgcaggttgttttccttcttacgatcctcattgaatcccctctgggagcacaggacagttagtagaactctccatttctttttttttttttttagacggagtctctctctgtcgccccggctggagtgcagtggcgcgatctcggctcactgcaacctccgcctcccgggttcaccccattctcctgcctcagcctccctagtagctgggactataggcgcccgccaccacgcctggctaatttttgtatttttattggagacggggtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgatattaggctaggggcggtggcttacgcctgtaatcccagcactttgggaggccgaggtgggtggattgcctgagctcaggagttcgagaccagtctgaccagtatggtgaaaccctgtctctactaaaaatacaaaaattagccggtcgtggtggcgtgcacctgtagtcccagctacttggcaggttgagacaggagaatcgcttgaacctgggaggtggaggttgcagtgagccgagactgcaccactgcgctcccacctgggtgacagagactctgtctcaaaaaaaaggacatttatcattataacatcttattagagcccctaatttcttatctgaaggcactgtttttttttttaaacagttaagtactgatgtcaacagacaaatatttctgatcagatagtcccctgtcaacagtagcaaatgtggtttcataaagtgggaagaaaacagcattttaaagtaactttttgggagactgatttgagtaataataaaactctggtctcccttaagaaaaaaaaacccttccacctttactgtgtcatttatatccccttagttccaaagttaattatcttatttctggatattgcttttataccaaagacccttatcagcccttgtaactacagtatctttagataagattcctctttccagtcagtcctgggaaatgtttctgttgcagagttaggcggtagatgggaagctgtgatggcagagctactatctaataaagtaacaactcgtagttgaggcttcctttctgtgtgtgatgggggatagggagttagctcccctgttgtctcagcactaagaaattgaggtcaggccaggcgcggtggttcactcctgttattccagcactggggtggccaaagtgggcagattgcttgcgctctggagctcgagaccagcctgggcaacatggtgaaaccctgtctctaccaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtagctgggactacaggcgtgcaccaccacacctggctaattttgtatttttagtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataacaacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgcc

SEQ ID NO: 152085 - DNA, 10008 bp, Homo sapiens
  Payload ID: 9932
  Gene Symbol: MDM4
  Gene Name: MDM4, p53 regulator
  ENST ID: ENST00000391947
  CDS Start-End: 167-589
gtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattccgttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttctgtcaccccaaaacactcccttctgcccctcttcagacagtccttcagctatttcatggctctcaccctagttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagtttttttttttttttgagagacggtctcactttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgtcgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctctttttttttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaaaaaaaaaaaaatcgtggaccgggcgtagtggctcacgcctgtaatcccaacactttgggagatcacctaggtcgggagtttgagaccagcctgaccgacatggagaaaccccatttttactaaaaatacaaaaaattagctgggcatggtggtgcatgcctgtagtcccagctactcaggaggctgaggcaggagaatcgcttgaacctgagagggggagattgcggtgagctgagattgcgccattgcaccccagcctgggcaacaatagcgaaactgtctcagaaaaaagaaaaaaaaaatcgcaaaaagaaaaatctcataatgtcgttgttggtttttttttttttttttgagacagtctcactctgttgcccaggctggagtgcaatggcatgatctctgctcaccgcaacctctgcctcccgggttcaggtgattctcctgcctcagcctcccagatagctgggactacaggcacataccaccatgcctggctaatttttgtatttttagtagagatgggggtttcactgtgttggccaggctggtctcgaactcctgacctcatgatccacacacctcggcctcccaaagtcctgcgattacaggcgtgagctaccgcacccagccaagttgtaatttttaataaaacttaagaagtaaacattttacttatgtttataggtatttgatcctaaatttgacacatcattgcccatgaaagaatcctcttaggctgctcagcttcactcttcctgcttgcccaccggggtttttcactgcttctgttagcactaagtacttagacgatcctaagatatgtgcttgagccgaatttcatctttacttgtaggaaactttaaactatttcttttcttttcttttttttttttttttacttgagatggagttttgctcttgtcgcccaggctggagtgcagtggagtgatctcggctcactgcaacctctgcctcccgggttcaaatgattctcctgcctcagcctcccaagtagctgggattacaggtgtgcaccaccatgtctggctaattttgtatttttagtagagatggtttcaccatgttggtcaggctggtctcgaactcctgacctcaggtcatccacccacctcagcctcgcaaagtgctgagattacaggcatgagccacagcgcccagcttaaactattttcttggtctgtttttgattttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgttacctcttgactcgcttttgaaaggaagacaattgttaactagatatttgagttttttcccctcagaattatgtgaatttctgatatatggctttagatactgtgaatctgttttccatttagtcagttatctgcttaaattgttcagaactatatcctaacgagcaattagttctgatggttctcccagtcatgagtgtgcatgtgtgcaagcatgttttgatcctgatgctacctttgctaaaaatggccatagattaggaactagctatgtttttagaatcaaagatgaaccggtaagctgtctcatgtaccaaacgtgaaatttacagtgtttacaaatgtctggaattttgcactgccatagggaatgttaaggttacttggctggaatttatcagacttgtgagtaaacaagttgaagtttagcagatgagggggaatattgaggcccctaaggctaaacaaaataatcagtatctgagatagtggctaatgtggctccccaggcctaatttgggaacagtttttcctgattgctttgagaagtactttcttttgacagaaattttcattctgcttgccattgctatattctccctttataggagccattggatttctttccttttgtgggaaatgtcccattagcattttcagatcttttgatgtgcactaatgccattattggtaatgccgttattggtgaatacagcatagttaaataaactgttacagtaaatctacacttggatttgctgcacctctaccaatagccttttgaatgactgaaagtgttaacagagaaagaggcatgtctgcagaaagagatagctaatattttttggtactttatctgaaatccaagatgctgcttcccctgcaggttgttttccttcttacgatcctcattgaatcccctctgggagcacaggacagttagtagaactctccatttctttttttttttttttagacggagtctctctctgtcgccccggctggagtgcagtggcgcgatctcggctcactgcaacctccgcctcccgggttcaccccattctcctgcctcagcctccctagtagctgggactataggcgcccgccaccacgcctggctaatttttgtatttttattggagacggggtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgatattaggctaggggcggtggcttacgcctgtaatcccagcactttgggaggccgaggtgggtggattgcctgagctcaggagttcgagaccagtctgaccagtatggtgaaaccctgtctctactaaaaatacaaaaattagccggtcgtggtggcgtgcacctgtagtcccagctacttggcaggttgagacaggagaatcgcttgaacctgggaggtggaggttgcagtgagccgagactgcaccactgcgctcccacctgggtgacagagactctgtctcaaaaaaaaggacatttatcattataacatcttattagagcccctaatttcttatctgaaggcactgtttttttttttaaacagttaagtactgatgtcaacagacaaatatttctgatcagatagtcccctgtcaacagtagcaaatgtggtttcataaagtgggaagaaaacagcattttaaagtaactttttgggagactgatttgagtaataataaaactctggtctcccttaagaaaaaaaaacccttccacctttactgtgtcatttatatccccttagttccaaagttaattatcttatttctggatattgcttttataccaaagacccttatcagcccttgtaactacagtatctttagataagattcctctttccagtcagtcctgggaaatgtttctgttgcagagttaggcggtagatgggaagctgtgatggcagagctactatctaataaagtaacaactcgtagttgaggcttcctttctgtgtgtgatgggggatagggagttagctcccctgttgtctcagcactaagaaattgaggtcaggccaggcgcggtggttcactcctgttattccagcactggggtggccaaagtgggcagattgcttgcgctctggagctcgagaccagcctgggcaacatggtgaaaccctgtctctaccaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtagctgggactacaggcgtgcaccaccacacctggctaattttgtatttttagtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataacaacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgcc

SEQ ID NO: 152086 - DNA, 513 bp, Homo sapiens
  Payload ID: 9932
  Gene Symbol: MDM4
  Gene Name: MDM4, p53 regulator
  ENST ID: ENST00000444261
  CDS Start-End: 1-513
gacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaa

SEQ ID NO: 152087 - DNA, 9926 bp, Homo sapiens
  Payload ID: 9932
  Gene Symbol: MDM4
  Gene Name: MDM4, p53 regulator
  Uniprot ID: O15151
  ENST ID: ENST00000454264
  CDS Start-End: 167-1489
gtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagatgctgctcagactctcgctctcgcacaggatcacagtatggatattccaagtcaagaccaactgaagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattccgttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttctgtcaccccaaaacactcccttctgcccctcttcagacagtccttcagctatttcatggctctcaccctagttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagtttttttttttttttgagagacggtctcactttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgtcgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctctttttttttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaaaaaaaaaaaaatcgtggaccgggcgtagtggctcacgcctgtaatcccaacactttgggagatcacctaggtcgggagtttgagaccagcctgaccgacatggagaaaccccatttttactaaaaatacaaaaaattagctgggcatggtggtgcatgcctgtagtcccagctactcaggaggctgaggcaggagaatcgcttgaacctgagagggggagattgcggtgagctgagattgcgccattgcaccccagcctgggcaacaatagcgaaactgtctcagaaaaaagaaaaaaaaaatcgcaaaaagaaaaatctcataatgtcgttgttggtttttttttttttttttgagacagtctcactctgttgcccaggctggagtgcaatggcatgatctctgctcaccgcaacctctgcctcccgggttcaggtgattctcctgcctcagcctcccagatagctgggactacaggcacataccaccatgcctggctaatttttgtatttttagtagagatgggggtttcactgtgttggccaggctggtctcgaactcctgacctcatgatccacacacctcggcctcccaaagtcctgcgattacaggcgtgagctaccgcacccagccaagttgtaatttttaataaaacttaagaagtaaacattttacttatgtttataggtatttgatcctaaatttgacacatcattgcccatgaaagaatcctcttaggctgctcagcttcactcttcctgcttgcccaccggggtttttcactgcttctgttagcactaagtacttagacgatcctaagatatgtgcttgagccgaatttcatctttacttgtaggaaactttaaactatttcttttcttttcttttttttttttttttacttgagatggagttttgctcttgtcgcccaggctggagtgcagtggagtgatctcggctcactgcaacctctgcctcccgggttcaaatgattctcctgcctcagcctcccaagtagctgggattacaggtgtgcaccaccatgtctggctaattttgtatttttagtagagatggtttcaccatgttggtcaggctggtctcgaactcctgacctcaggtcatccacccacctcagcctcgcaaagtgctgagattacaggcatgagccacagcgcccagcttaaactattttcttggtctgtttttgattttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgttacctcttgactcgcttttgaaaggaagacaattgttaactagatatttgagttttttcccctcagaattatgtgaatttctgatatatggctttagatactgtgaatctgttttccatttagtcagttatctgcttaaattgttcagaactatatcctaacgagcaattagttctgatggttctcccagtcatgagtgtgcatgtgtgcaagcatgttttgatcctgatgctacctttgctaaaaatggccatagattaggaactagctatgtttttagaatcaaagatgaaccggtaagctgtctcatgtaccaaacgtgaaatttacagtgtttacaaatgtctggaattttgcactgccatagggaatgttaaggttacttggctggaatttatcagacttgtgagtaaacaagttgaagtttagcagatgagggggaatattgaggcccctaaggctaaacaaaataatcagtatctgagatagtggctaatgtggctccccaggcctaatttgggaacagtttttcctgattgctttgagaagtactttcttttgacagaaattttcattctgcttgccattgctatattctccctttataggagccattggatttctttccttttgtgggaaatgtcccattagcattttcagatcttttgatgtgcactaatgccattattggtaatgccgttattggtgaatacagcatagttaaataaactgttacagtaaatctacacttggatttgctgcacctctaccaatagccttttgaatgactgaaagtgttaacagagaaagaggcatgtctgcagaaagagatagctaatattttttggtactttatctgaaatccaagatgctgcttcccctgcaggttgttttccttcttacgatcctcattgaatcccctctgggagcacaggacagttagtagaactctccatttctttttttttttttttagacggagtctctctctgtcgccccggctggagtgcagtggcgcgatctcggctcactgcaacctccgcctcccgggttcaccccattctcctgcctcagcctccctagtagctgggactataggcgcccgccaccacgcctggctaatttttgtatttttattggagacggggtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgatattaggctaggggcggtggcttacgcctgtaatcccagcactttgggaggccgaggtgggtggattgcctgagctcaggagttcgagaccagtctgaccagtatggtgaaaccctgtctctactaaaaatacaaaaattagccggtcgtggtggcgtgcacctgtagtcccagctacttggcaggttgagacaggagaatcgcttgaacctgggaggtggaggttgcagtgagccgagactgcaccactgcgctcccacctgggtgacagagactctgtctcaaaaaaaaggacatttatcattataacatcttattagagcccctaatttcttatctgaaggcactgtttttttttttaaacagttaagtactgatgtcaacagacaaatatttctgatcagatagtcccctgtcaacagtagcaaatgtggtttcataaagtgggaagaaaacagcattttaaagtaactttttgggagactgatttgagtaataataaaactctggtctcccttaagaaaaaaaaacccttccacctttactgtgtcatttatatccccttagttccaaagttaattatcttatttctggatattgcttttataccaaagacccttatcagcccttgtaactacagtatctttagataagattcctctttccagtcagtcctgggaaatgtttctgttgcagagttaggcggtagatgggaagctgtgatggcagagctactatctaataaagtaacaactcgtagttgaggcttcctttctgtgtgtgatgggggatagggagttagctcccctgttgtctcagcactaagaaattgaggtcaggccaggcgcggtggttcactcctgttattccagcactggggtggccaaagtgggcagattgcttgcgctctggagctcgagaccagcctgggcaacatggtgaaaccctgtctctaccaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtagctgggactacaggcgtgcaccaccacacctggctaattttgtatttttagtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataacaacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgcc

SEQ ID NO: 152088 - DNA, 481 bp, Homo sapiens
  Payload ID: 9932
  Gene Symbol: MDM4
  Gene Name: MDM4, p53 regulator
  ENST ID: ENST00000507825
  CDS Start-End: 1-423
atgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagcaaagtgcagaggaaagttccacttccagaaaaagaactacagaagacgatatccccacactgcctacctcagagcataaatgcatacattctagagaaggtgattgaagtgggaaaaaatgatgacctggaggactc

SEQ ID NO: 152089 - DNA, 9407 bp, Homo sapiens
  Payload ID: 9932
  Gene Symbol: MDM4
  Gene Name: MDM4, p53 regulator
  ENST ID: ENST00000612738
  CDS Start-End: 167-970
gtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattccgttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttctgtcaccccaaaacactcccttctgcccctcttcagacagtccttcagctatttcatggctctcaccctagttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagtttttttttttttttgagagacggtctcactttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgtcgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctctttttttttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaaaaaaaaaaaaatcgtggaccgggcgtagtggctcacgcctgtaatcccaacactttgggagatcacctaggtcgggagtttgagaccagcctgaccgacatggagaaaccccatttttactaaaaatacaaaaaattagctgggcatggtggtgcatgcctgtagtcccagctactcaggaggctgaggcaggagaatcgcttgaacctgagagggggagattgcggtgagctgagattgcgccattgcaccccagcctgggcaacaatagcgaaactgtctcagaaaaaagaaaaaaaaaatcgcaaaaagaaaaatctcataatgtcgttgttggtttttttttttttttttgagacagtctcactctgttgcccaggctggagtgcaatggcatgatctctgctcaccgcaacctctgcctcccgggttcaggtgattctcctgcctcagcctcccagatagctgggactacaggcacataccaccatgcctggctaatttttgtatttttagtagagatgggggtttcactgtgttggccaggctggtctcgaactcctgacctcatgatccacacacctcggcctcccaaagtcctgcgattacaggcgtgagctaccgcacccagccaagttgtaatttttaataaaacttaagaagtaaacattttacttatgtttataggtatttgatcctaaatttgacacatcattgcccatgaaagaatcctcttaggctgctcagcttcactcttcctgcttgcccaccggggtttttcactgcttctgttagcactaagtacttagacgatcctaagatatgtgcttgagccgaatttcatctttacttgtaggaaactttaaactatttcttttcttttcttttttttttttttttacttgagatggagttttgctcttgtcgcccaggctggagtgcagtggagtgatctcggctcactgcaacctctgcctcccgggttcaaatgattctcctgcctcagcctcccaagtagctgggattacaggtgtgcaccaccatgtctggctaattttgtatttttagtagagatggtttcaccatgttggtcaggctggtctcgaactcctgacctcaggtcatccacccacctcagcctcgcaaagtgctgagattacaggcatgagccacagcgcccagcttaaactattttcttggtctgtttttgattttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgttacctcttgactcgcttttgaaaggaagacaattgttaactagatatttgagttttttcccctcagaattatgtgaatttctgatatatggctttagatactgtgaatctgttttccatttagtcagttatctgcttaaattgttcagaactatatcctaacgagcaattagttctgatggttctcccagtcatgagtgtgcatgtgtgcaagcatgttttgatcctgatgctacctttgctaaaaatggccatagattaggaactagctatgtttttagaatcaaagatgaaccggtaagctgtctcatgtaccaaacgtgaaatttacagtgtttacaaatgtctggaattttgcactgccatagggaatgttaaggttacttggctggaatttatcagacttgtgagtaaacaagttgaagtttagcagatgagggggaatattgaggcccctaaggctaaacaaaataatcagtatctgagatagtggctaatgtggctccccaggcctaatttgggaacagtttttcctgattgctttgagaagtactttcttttgacagaaattttcattctgcttgccattgctatattctccctttataggagccattggatttctttccttttgtgggaaatgtcccattagcattttcagatcttttgatgtgcactaatgccattattggtaatgccgttattggtgaatacagcatagttaaataaactgttacagtaaatctacacttggatttgctgcacctctaccaatagccttttgaatgactgaaagtgttaacagagaaagaggcatgtctgcagaaagagatagctaatattttttggtactttatctgaaatccaagatgctgcttcccctgcaggttgttttccttcttacgatcctcattgaatcccctctgggagcacaggacagttagtagaactctccatttctttttttttttttttagacggagtctctctctgtcgccccggctggagtgcagtggcgcgatctcggctcactgcaacctccgcctcccgggttcaccccattctcctgcctcagcctccctagtagctgggactataggcgcccgccaccacgcctggctaatttttgtatttttattggagacggggtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgatattaggctaggggcggtggcttacgcctgtaatcccagcactttgggaggccgaggtgggtggattgcctgagctcaggagttcgagaccagtctgaccagtatggtgaaaccctgtctctactaaaaatacaaaaattagccggtcgtggtggcgtgcacctgtagtcccagctacttggcaggttgagacaggagaatcgcttgaacctgggaggtggaggttgcagtgagccgagactgcaccactgcgctcccacctgggtgacagagactctgtctcaaaaaaaaggacatttatcattataacatcttattagagcccctaatttcttatctgaaggcactgtttttttttttaaacagttaagtactgatgtcaacagacaaatatttctgatcagatagtcccctgtcaacagtagcaaatgtggtttcataaagtgggaagaaaacagcattttaaagtaactttttgggagactgatttgagtaataataaaactctggtctcccttaagaaaaaaaaacccttccacctttactgtgtcatttatatccccttagttccaaagttaattatcttatttctggatattgcttttataccaaagacccttatcagcccttgtaactacagtatctttagataagattcctctttccagtcagtcctgggaaatgtttctgttgcagagttaggcggtagatgggaagctgtgatggcagagctactatctaataaagtaacaactcgtagttgaggcttcctttctgtgtgtgatgggggatagggagttagctcccctgttgtctcagcactaagaaattgaggtcaggccaggcgcggtggttcactcctgttattccagcactggggtggccaaagtgggcagattgcttgcgctctggagctcgagaccagcctgggcaacatggtgaaaccctgtctctaccaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtagctgggactacaggcgtgcaccaccacacctggctaattttgtatttttagtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataacaacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgcc

SEQ ID NO: 152090 - DNA, 9597 bp, Homo sapiens
  Payload ID: 9932
  Gene Symbol: MDM4
  Gene Name: MDM4, p53 regulator
  ENST ID: ENST00000616250
  CDS Start-End: 167-517
gtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattccgttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttctgtcaccccaaaacactcccttctgcccctcttcagacagtccttcagctatttcatggctctcaccctagttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagtttttttttttttttgagagacggtctcactttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgtcgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctctttttttttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaaaaaaaaaaaaatcgtggaccgggcgtagtggctcacgcctgtaatcccaacactttgggagatcacctaggtcgggagtttgagaccagcctgaccgacatggagaaaccccatttttactaaaaatacaaaaaattagctgggcatggtggtgcatgcctgtagtcccagctactcaggaggctgaggcaggagaatcgcttgaacctgagagggggagattgcggtgagctgagattgcgccattgcaccccagcctgggcaacaatagcgaaactgtctcagaaaaaagaaaaaaaaaatcgcaaaaagaaaaatctcataatgtcgttgttggtttttttttttttttttgagacagtctcactctgttgcccaggctggagtgcaatggcatgatctctgctcaccgcaacctctgcctcccgggttcaggtgattctcctgcctcagcctcccagatagctgggactacaggcacataccaccatgcctggctaatttttgtatttttagtagagatgggggtttcactgtgttggccaggctggtctcgaactcctgacctcatgatccacacacctcggcctcccaaagtcctgcgattacaggcgtgagctaccgcacccagccaagttgtaatttttaataaaacttaagaagtaaacattttacttatgtttataggtatttgatcctaaatttgacacatcattgcccatgaaagaatcctcttaggctgctcagcttcactcttcctgcttgcccaccggggtttttcactgcttctgttagcactaagtacttagacgatcctaagatatgtgcttgagccgaatttcatctttacttgtaggaaactttaaactatttcttttcttttcttttttttttttttttacttgagatggagttttgctcttgtcgcccaggctggagtgcagtggagtgatctcggctcactgcaacctctgcctcccgggttcaaatgattctcctgcctcagcctcccaagtagctgggattacaggtgtgcaccaccatgtctggctaattttgtatttttagtagagatggtttcaccatgttggtcaggctggtctcgaactcctgacctcaggtcatccacccacctcagcctcgcaaagtgctgagattacaggcatgagccacagcgcccagcttaaactattttcttggtctgtttttgattttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgttacctcttgactcgcttttgaaaggaagacaattgttaactagatatttgagttttttcccctcagaattatgtgaatttctgatatatggctttagatactgtgaatctgttttccatttagtcagttatctgcttaaattgttcagaactatatcctaacgagcaattagttctgatggttctcccagtcatgagtgtgcatgtgtgcaagcatgttttgatcctgatgctacctttgctaaaaatggccatagattaggaactagctatgtttttagaatcaaagatgaaccggtaagctgtctcatgtaccaaacgtgaaatttacagtgtttacaaatgtctggaattttgcactgccatagggaatgttaaggttacttggctggaatttatcagacttgtgagtaaacaagttgaagtttagcagatgagggggaatattgaggcccctaaggctaaacaaaataatcagtatctgagatagtggctaatgtggctccccaggcctaatttgggaacagtttttcctgattgctttgagaagtactttcttttgacagaaattttcattctgcttgccattgctatattctccctttataggagccattggatttctttccttttgtgggaaatgtcccattagcattttcagatcttttgatgtgcactaatgccattattggtaatgccgttattggtgaatacagcatagttaaataaactgttacagtaaatctacacttggatttgctgcacctctaccaatagccttttgaatgactgaaagtgttaacagagaaagaggcatgtctgcagaaagagatagctaatattttttggtactttatctgaaatccaagatgctgcttcccctgcaggttgttttccttcttacgatcctcattgaatcccctctgggagcacaggacagttagtagaactctccatttctttttttttttttttagacggagtctctctctgtcgccccggctggagtgcagtggcgcgatctcggctcactgcaacctccgcctcccgggttcaccccattctcctgcctcagcctccctagtagctgggactataggcgcccgccaccacgcctggctaatttttgtatttttattggagacggggtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgatattaggctaggggcggtggcttacgcctgtaatcccagcactttgggaggccgaggtgggtggattgcctgagctcaggagttcgagaccagtctgaccagtatggtgaaaccctgtctctactaaaaatacaaaaattagccggtcgtggtggcgtgcacctgtagtcccagctacttggcaggttgagacaggagaatcgcttgaacctgggaggtggaggttgcagtgagccgagactgcaccactgcgctcccacctgggtgacagagactctgtctcaaaaaaaaggacatttatcattataacatcttattagagcccctaatttcttatctgaaggcactgtttttttttttaaacagttaagtactgatgtcaacagacaaatatttctgatcagatagtcccctgtcaacagtagcaaatgtggtttcataaagtgggaagaaaacagcattttaaagtaactttttgggagactgatttgagtaataataaaactctggtctcccttaagaaaaaaaaacccttccacctttactgtgtcatttatatccccttagttccaaagttaattatcttatttctggatattgcttttataccaaagacccttatcagcccttgtaactacagtatctttagataagattcctctttccagtcagtcctgggaaatgtttctgttgcagagttaggcggtagatgggaagctgtgatggcagagctactatctaataaagtaacaactcgtagttgaggcttcctttctgtgtgtgatgggggatagggagttagctcccctgttgtctcagcactaagaaattgaggtcaggccaggcgcggtggttcactcctgttattccagcactggggtggccaaagtgggcagattgcttgcgctctggagctcgagaccagcctgggcaacatggtgaaaccctgtctctaccaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtagctgggactacaggcgtgcaccaccacacctggctaattttgtatttttagtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataacaacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgcc

SEQ ID NO: 152091 - DNA, 9782 bp, Homo sapiens
  Payload ID: 9932
  Gene Symbol: MDM4
  Gene Name: MDM4, p53 regulator
  ENST ID: ENST00000614459
  CDS Start-End: 167-1345
gtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggatcacagtatggatattccaagtcaagaccaactgaagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattccgttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttctgtcaccccaaaacactcccttctgcccctcttcagacagtccttcagctatttcatggctctcaccctagttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagtttttttttttttttgagagacggtctcactttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgtcgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctctttttttttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaaaaaaaaaaaaatcgtggaccgggcgtagtggctcacgcctgtaatcccaacactttgggagatcacctaggtcgggagtttgagaccagcctgaccgacatggagaaaccccatttttactaaaaatacaaaaaattagctgggcatggtggtgcatgcctgtagtcccagctactcaggaggctgaggcaggagaatcgcttgaacctgagagggggagattgcggtgagctgagattgcgccattgcaccccagcctgggcaacaatagcgaaactgtctcagaaaaaagaaaaaaaaaatcgcaaaaagaaaaatctcataatgtcgttgttggtttttttttttttttttgagacagtctcactctgttgcccaggctggagtgcaatggcatgatctctgctcaccgcaacctctgcctcccgggttcaggtgattctcctgcctcagcctcccagatagctgggactacaggcacataccaccatgcctggctaatttttgtatttttagtagagatgggggtttcactgtgttggccaggctggtctcgaactcctgacctcatgatccacacacctcggcctcccaaagtcctgcgattacaggcgtgagctaccgcacccagccaagttgtaatttttaataaaacttaagaagtaaacattttacttatgtttataggtatttgatcctaaatttgacacatcattgcccatgaaagaatcctcttaggctgctcagcttcactcttcctgcttgcccaccggggtttttcactgcttctgttagcactaagtacttagacgatcctaagatatgtgcttgagccgaatttcatctttacttgtaggaaactttaaactatttcttttcttttcttttttttttttttttacttgagatggagttttgctcttgtcgcccaggctggagtgcagtggagtgatctcggctcactgcaacctctgcctcccgggttcaaatgattctcctgcctcagcctcccaagtagctgggattacaggtgtgcaccaccatgtctggctaattttgtatttttagtagagatggtttcaccatgttggtcaggctggtctcgaactcctgacctcaggtcatccacccacctcagcctcgcaaagtgctgagattacaggcatgagccacagcgcccagcttaaactattttcttggtctgtttttgattttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgttacctcttgactcgcttttgaaaggaagacaattgttaactagatatttgagttttttcccctcagaattatgtgaatttctgatatatggctttagatactgtgaatctgttttccatttagtcagttatctgcttaaattgttcagaactatatcctaacgagcaattagttctgatggttctcccagtcatgagtgtgcatgtgtgcaagcatgttttgatcctgatgctacctttgctaaaaatggccatagattaggaactagctatgtttttagaatcaaagatgaaccggtaagctgtctcatgtaccaaacgtgaaatttacagtgtttacaaatgtctggaattttgcactgccatagggaatgttaaggttacttggctggaatttatcagacttgtgagtaaacaagttgaagtttagcagatgagggggaatattgaggcccctaaggctaaacaaaataatcagtatctgagatagtggctaatgtggctccccaggcctaatttgggaacagtttttcctgattgctttgagaagtactttcttttgacagaaattttcattctgcttgccattgctatattctccctttataggagccattggatttctttccttttgtgggaaatgtcccattagcattttcagatcttttgatgtgcactaatgccattattggtaatgccgttattggtgaatacagcatagttaaataaactgttacagtaaatctacacttggatttgctgcacctctaccaatagccttttgaatgactgaaagtgttaacagagaaagaggcatgtctgcagaaagagatagctaatattttttggtactttatctgaaatccaagatgctgcttcccctgcaggttgttttccttcttacgatcctcattgaatcccctctgggagcacaggacagttagtagaactctccatttctttttttttttttttagacggagtctctctctgtcgccccggctggagtgcagtggcgcgatctcggctcactgcaacctccgcctcccgggttcaccccattctcctgcctcagcctccctagtagctgggactataggcgcccgccaccacgcctggctaatttttgtatttttattggagacggggtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgatattaggctaggggcggtggcttacgcctgtaatcccagcactttgggaggccgaggtgggtggattgcctgagctcaggagttcgagaccagtctgaccagtatggtgaaaccctgtctctactaaaaatacaaaaattagccggtcgtggtggcgtgcacctgtagtcccagctacttggcaggttgagacaggagaatcgcttgaacctgggaggtggaggttgcagtgagccgagactgcaccactgcgctcccacctgggtgacagagactctgtctcaaaaaaaaggacatttatcattataacatcttattagagcccctaatttcttatctgaaggcactgtttttttttttaaacagttaagtactgatgtcaacagacaaatatttctgatcagatagtcccctgtcaacagtagcaaatgtggtttcataaagtgggaagaaaacagcattttaaagtaactttttgggagactgatttgagtaataataaaactctggtctcccttaagaaaaaaaaacccttccacctttactgtgtcatttatatccccttagttccaaagttaattatcttatttctggatattgcttttataccaaagacccttatcagcccttgtaactacagtatctttagataagattcctctttccagtcagtcctgggaaatgtttctgttgcagagttaggcggtagatgggaagctgtgatggcagagctactatctaataaagtaacaactcgtagttgaggcttcctttctgtgtgtgatgggggatagggagttagctcccctgttgtctcagcactaagaaattgaggtcaggccaggcgcggtggttcactcctgttattccagcactggggtggccaaagtgggcagattgcttgcgctctggagctcgagaccagcctgggcaacatggtgaaaccctgtctctaccaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtagctgggactacaggcgtgcaccaccacacctggctaattttgtatttttagtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataacaacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgcc

SEQ ID NO: 152092 - DNA, 5592 bp, Homo sapiens
  Payload ID: 9932
  Gene Symbol: MDM4
  Gene Name: MDM4, p53 regulator
  ENST ID: ENST00000621032
  CDS Start-End: 140-601
attactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacaggatcacagtatggatattccaagtcaagaccaactgaagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattccgttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttctgtcaccccaaaacactcccttctgcccctcttcagacagtccttcagctatttcatggctctcaccctagttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagtttttttttttttttgagagacggtctcactttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgtcgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctctttttttttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaaaaaaaaaaaaatcgtggaccgggcgtagtggctcacgcctggtctcgaactcctgacctcatgatccacacacctcggcctcccaaagtcctgcgattacaggcgtgagctaccgcacccagccaagttgtaatttttaataaaacttaagaagtaaacattttacttatgtttataggtatttgatcctaaatttgacacatcattgcccatgaaagaatcctcttaggctgctcagcttcactcttcctgcttgcccaccggggtttttcactgcttctgttagcactaagtacttagacgatcctaagatatgtgcttgagccgaatttcatctttacttgtaggaaactttaaactatttcttttcttttcttttttttttttttttacttgagatggagttttgctcttgtcgcccaggctggagtgcagtggagtgatctcggctcactgcaacctctgcctcccgggttcaaatgattctcctgcctcagcctcccaagtagctgggattacaggtgtgcaccaccatgtctggctaattttgtatttttagtagagatggtttcaccatgttggtcaggctggtctcgaactcctgacctcaggtcatccacccacctcagcctcgcaaagtgctgagattacaggcatgagccacagcgcccagcttaaactattttcttggtctgtttttgattttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgtt

SEQ ID NO: 152093 - DNA, 4900 bp, Homo sapiens
  Payload ID: 9933
  Gene Symbol: MECOM
  Gene Name: MDS1 and EVI1 complex locus
  Uniprot ID: Q03112
  ENST ID: ENST00000264674
  CDS Start-End: 140-3490
ccttgccaagtaacagctttgctgtccaacatcgtgtgctgcttcgcgagaaagtcacattcggaccctttggctagattgcttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaagcaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagtattttt

SEQ ID NO: 152094 - DNA, 3508 bp, Homo sapiens
  Payload ID: 9933
  Gene Symbol: MECOM
  Gene Name: MDS1 and EVI1 complex locus
  ENST ID: ENST00000433243
  CDS Start-End: 315-3473
tttgctgtccaacatcgtgtgctgcttcgcgagaaagtcacattcggaccctttggctagattgcttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaagcaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtcca

SEQ ID NO: 152095 - DNA, 638 bp, Homo sapiens
  Payload ID: 9933
  Gene Symbol: MECOM
  Gene Name: MDS1 and EVI1 complex locus
  ENST ID: ENST00000484519
  CDS Start-End: 263-638
ttatctacgttgctaagccgggcgatttccttgttcctcctgcgaaacggtgcggtctggacacgtctccgggatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatg

SEQ ID NO: 152096 - DNA, 965 bp, Homo sapiens
  Payload ID: 9933
  Gene Symbol: MECOM
  Gene Name: MDS1 and EVI1 complex locus
  ENST ID: ENST00000492586
  CDS Start-End: 1-965
tgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccaca

SEQ ID NO: 152097 - DNA, 3939 bp, Homo sapiens
  Payload ID: 9933
  Gene Symbol: MECOM
  Gene Name: MDS1 and EVI1 complex locus
  ENST ID: ENST00000494292
  CDS Start-End: 99-3791
agagagagggagggagcgagagggagagcaaaagaaggaaaggatccaagaaaaaaaagccccaaccacacaccagcggctgcaggactgggcacagcatgagatccaaaggcagggcaaggaaactggccacaaataatgagtgtgtatatggcaactaccctgaaatacctttggaagaaatgccagatgcagatggagtagccagcactccctccctcaatattcaagagccatgctctcctgccacatccagtgaagcattcactccaaaggagggttctccttacaaagcccccatctacatccctgatgatatccccattcctgctgagtttgaacttcgagagtcaaatatgcctggggcaggactaggaatatggaccaaaaggaagatcgaagtaggtgaaaagtttgggccttatgtgggagagcagaggtcaaacctgaaagaccccagttatggatgggagatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaaatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgattta

SEQ ID NO: 152098 - DNA, 1792 bp, Homo sapiens
  Payload ID: 9933
  Gene Symbol: MECOM
  Gene Name: MDS1 and EVI1 complex locus
  ENST ID: ENST00000460890
  CDS Start-End: 1482-1792
tttgctgtccaacatcgtgtgctgcttcgcgagaaagtcacattcggaccctttggctagattgtggggatttttttttttttccttttgctgttggttttttgaaagggcctttctctaaagtctacctaaacggtttttttttaagctatctttggaggttgacagcttttaaaaacacaggagtgtgttatatgaaatgactgaagatgtgtcgttactttattttattcgagatttccgacacgattaagacatttgggagacaaatgcagttctgctagcaaatcaaaagtgaataattcacccagggggcaaacgtttctggagaaagctaagcttttgtcttggggcaagaatattgagaggaagaatgttaatatgatggtgaaatctttgaataatcgtataacagattagtaaaaagacattctttggaaatgaacctttttaaaaattaattttgctgttgacagtggcaatgctaataatgttaacacggaataaaattacacctacaatttttatgtgcagtgtatgtaatacttaactccctgcccctgtgaaagggtatgcttgaaagctaaggggatggatgcttcttgactttgaaattaacaagttttccacgtctctctgcaaatatgaaatggaattagtattgcatttcactggctttattctatgtcctttattaaatatttctttggtgtgtcaggagaactgccttttctttttctttttttcttttttttcttttttttgccagtcaaggaaacaaacaacaaaagatcaaccagaaaccaaacagactgaacaaaccaacaaaacccagcaacaaactccaactttttactatttaaaaatgtgcattgctattatttatgtaccttctcaacatctgggatggggggaaatctcaagttgccatttgagttactcagcactgagagttgaagaaacatcttaaagtttgtaattttattgataacaaatttttagaatttgtcctcttaatagaaaggatgtttaagtgtacacttctgtcgttgttagtgtgaagaggcatccttgaaaaagaagagtttgatttctctctgtgtgtgtgtgtgtgtgtgtgtgtgtgtgtgtgtgtgtgtgtgtgtttaataatatccctatcttatgttcgatttttcttttttaaattttgggacgacttattgcccttcaatttcctcatggccaaaggcttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaa

SEQ ID NO: 152099 - DNA, 379 bp, Homo sapiens
  Payload ID: 9933
  Gene Symbol: MECOM
  Gene Name: MDS1 and EVI1 complex locus
  ENST ID: ENST00000481315
  CDS Start-End: 294-379
agagcattcaaaaaagtctccatgcctcagtgtattaatctagaaaaggagagcagcaacataatggcaggctgaccacctaggaatagcatgagaacacgaagatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagct

SEQ ID NO: 152100 - DNA, 468 bp, Homo sapiens
  Payload ID: 9933
  Gene Symbol: MECOM
  Gene Name: MDS1 and EVI1 complex locus
  ENST ID: ENST00000466623
  CDS Start-End: 404-468
gtggtttgctagggtgctttgaggattcagagaagggaaagttcttcgttaaacattacacaggatatatgtgacgcagctagccttgcattaagaaaatttgatttgtgaagtaggatttggaaaagatttgtgaactggcttgagagtcacagctttccatttgtcaccagagggctggttttcaatatataaaacaggaaatcacacttcttttgataaaaaagaaaaagaaaaagatgtttgttaaggtgtttgtacaggtatcttagtgtatatcttgccctttgttaatatatatacatctctctctttcctgattccatccacctttattttgtctttaaagatattctatagagtagttgcagacattgcgccgggagaggagcttctgctgttcatgaagagcgaagactatccccatgaaactatggcgccggatatccacgaagaacggcaatatcg

SEQ ID NO: 152101 - DNA, 580 bp, Homo sapiens
  Payload ID: 9933
  Gene Symbol: MECOM
  Gene Name: MDS1 and EVI1 complex locus
  ENST ID: ENST00000475754
  CDS Start-End: 378-580
cttgttcctcctgcgaaacggtgcggtctggacacgtctccggggtgggtcgtccggccttcgatcttagacgaattttacaatgtgaagttctgcatagatgccagtcaaccagatgttggaagctggctcaagtacattagattcgctggctgttatgatcagcacaaccttgttgcatgccagataaatgatcaggaaagaagctaagcagaaaatactcctcattaagttatttttcaaatttagcacaattttgtgctccggtcttgttatagaaaaataaacaattggactttagagccacctactggaataaagagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatct

SEQ ID NO: 152102 - DNA, 393 bp, Homo sapiens
  Payload ID: 9933
  Gene Symbol: MECOM
  Gene Name: MDS1 and EVI1 complex locus
  ENST ID: ENST00000486748
  CDS Start-End: 19-393
tgcaggactgggcacagcatgagatccaaaggcagggcaaggaaactggccacaaaaggtccttgtttccccttcgccttccaccacaattgtaagtttcctgaggcctccccagccacacagaactataatgagtgtgtatatggcaactaccctgaaatacctttggaagaaatgccagatgcagatggagtagccagcactccctccctcaatattcaagagccatgctctcctgccacatccagtgaagcattcactccaaaggagggttctccttacaaagcccccatctacatccctgatgatatccccattcctgctgagtttgaacttcgagagtcaaatatgcctggggcaggactaggaatatggaccaaaaggaagatcgaa

SEQ ID NO: 152103 - DNA, 1533 bp, Homo sapiens
  Payload ID: 9933
  Gene Symbol: MECOM
  Gene Name: MDS1 and EVI1 complex locus
  ENST ID: ENST00000487503
  CDS Start-End: 1223-1533
tttgctgtccaacatcgtgtgctgcttcgcgagaaagtcacattcggaccctttggctagattgtggggatttttttttttttccttttgctgttggttttttgaaagggcctttctctaaagtctacctaaacggtttttttttaagctatctttggaggttgacagcttttaaaaacacaggagtgtgttatatgaaatgactgaagatgtgtcgttactttattttattcgagatttccgacacgattaagacatttgggagacaaatgcagttctgctagcaaatcaaaagtgaataattcacccagggggcaaacgtttctggagaaagctaagcttttgtcttggggcaagaatattgagaggaagaatgttaatatgatggtgaaatctttgaataatcgtataacagattagtaaaaagacattctttggaaatgaacctttttaaaaattaattttgctgttgacagtggcaatgctaataatgttaacacggaataaaattacacctacaatttttatgtgcagtgtatgtaatacttaactccctgcccctgtgaaagggtatgcttgaaagctaaggggatggatgcttcttgactttgaaattaacaagttttccacgtctctctgcaaatatgaaatggaattagtattgcatttcactggctttattctatgtcctttattaaatatttctttggtgtgtcaggagaactgccttttctttttctttttttcttttttttcttttttttgccagtcaaggaaacaaacaacaaaagatcaaccagaaaccaaacagactgaacaaaccaacaaaacccagcaacaaactccaactttttactatttaaaaatgtgcattgctattatttatgtaccttctcaacatctgggatggggggaaatctcaagttgccatttgagttactcagcactgagagttgaagaaacatcttaaagcttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaa

SEQ ID NO: 152104 - DNA, 5732 bp, Homo sapiens
  Payload ID: 9933
  Gene Symbol: MECOM
  Gene Name: MDS1 and EVI1 complex locus
  Uniprot ID: Q03112
  ENST ID: ENST00000464456
  CDS Start-End: 1202-4330
cacacacacacacacacaccacacttgtgctttcaagacatcgaaacggaggctatttccctggggaaagaaatcctgcctggcgagatctccccattggttgtttacccggagaaatctacatgtttaagggggatggtgcatccataatcagtctgtccctataggacttgggtcttggcgacctttttgtgacctctcccgccagaggaggctgctgtcactttaaaaatttaaaagaggagcccgtctggcttccgatcagatcactctgggcggcgggagatagctccctttctccctcgccccgggttctttctggatggccgagcagatcctctttaaagagacagttcatgaaatagaaacccggcggctgagcttggagttgcgaaaggggacgatcccgtgagggtccaggacccgcgaaggcgctgcggaggatctgaaagggggatagagctcccctcgcctccccaggccccccaccttttcaaactctcctcctcctgcttgttttcccccattggaactgggaaggagaagtagaagttttagtgggtttcagataactttcattacacatcgggctgataagagcaagagaaagtgagaaaagagggaggtgatgtgaaccagaaggaatagctccgagctcatttaggaagggggaaaaagccaaaacacaccaaacccgggtcacccagacgaaagaagacttcatttcttgtattaaaaatacactgttggcggacaataaatccgaaacgcgtggtcctggagagcagatcctagagacggacaaagttgtcagagacccatttggaaatcgagacgcgaggcttttaaaaaattattattattatttttaaacatctctaaatgttgctcgggatcgtttgaaaggattttcgtgcaggagcgttgggggctgctgattattttattttgtttattttgattcttctgtgaatgcctattattgctgagttgaggccatagaaatctaaagatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaaatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaagga

SEQ ID NO: 152105 - DNA, 3691 bp, Homo sapiens
  Payload ID: 9933
  Gene Symbol: MECOM
  Gene Name: MDS1 and EVI1 complex locus
  Uniprot ID: Q03112
  ENST ID: ENST00000468789
  CDS Start-End: 389-3544
aaagtttgtcacttcggacagtttcctgccggggcaccgtttctacgggcgccccccgcccccagccttctttcctcctcgcccgcagtctcgcggagccctgctgcttatctacgttgctaagccgggcgatttccttgttcctcctgcgaaacggtgcggtctggacacgtctccggggtgggtcgtccggccttcgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgattt

SEQ ID NO: 152106 - DNA, 3593 bp, Homo sapiens
  Payload ID: 9933
  Gene Symbol: MECOM
  Gene Name: MDS1 and EVI1 complex locus
  ENST ID: ENST00000472280
  CDS Start-End: 270-3428
ccttgccaagtaacagctttgctgtccaacatcgtgtgctgcttcgcgagaaagtcacattcggaccctttggctagattatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaagcaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaa

SEQ ID NO: 152107 - DNA, 1097 bp, Homo sapiens
  Payload ID: 9933
  Gene Symbol: MECOM
  Gene Name: MDS1 and EVI1 complex locus
  ENST ID: ENST00000494597
  CDS Start-End: 787-1097
tttgctgtccaacatcgtgtgctgcttcgcgagaaagtcacattcggaccctttggctagattgtggggatttttttttttttccttttgctgttggttttttgaaagggcctttctctaaagtctacctaaacggtttttttttaagctatctttggaggttgacagcttttaaaaacacaggagtgtgttatatgaaatgactgaagatgtgtcgttactttattttattcgagatttccgacacgattaagacatttgggagacaaatgcagttctgctagcaaatcaaaagtgaataattcacccagggggcaaacgtttctggagaaagctaagcttttgtcttggggcaagaatattgagaggaagaatgttaatatgatggtgaaatctttgaataatcgtataacagattagtaaaaagacattctttggaaatgaacctttttaaaaattaattttgctgttgacagtggcaatgctaataatgttaacacggaataaaattacacctacaatttttatgtgcagtgcttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaa

SEQ ID NO: 152108 - DNA, 3374 bp, Homo sapiens
  Payload ID: 9933
  Gene Symbol: MECOM
  Gene Name: MDS1 and EVI1 complex locus
  ENST ID: ENST00000460814
  CDS Start-End: 114-3125
aacatgttgttggaaaggaagctaataagttaaacctttgagagatgccaaaaaaagagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaaatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggaggaaagtaaagcttaaaaggttaagcaacttgctcaagatcacacagctaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgct

SEQ ID NO: 152109 - DNA, 4835 bp, Homo sapiens
  Payload ID: 9933
  Gene Symbol: MECOM
  Gene Name: MDS1 and EVI1 complex locus
  Uniprot ID: Q03112
  ENST ID: ENST00000628990
  CDS Start-End: 270-3425
ccttgccaagtaacagctttgctgtccaacatcgtgtgctgcttcgcgagaaagtcacattcggaccctttggctagattatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagtattttt

SEQ ID NO: 152110 - DNA, 8677 bp, Homo sapiens
  Payload ID: 9934
  Gene Symbol: MTOR
  Gene Name: mechanistic target of rapamycin (serine/threonine kinase)
  Uniprot ID: P42345
  ENST ID: ENST00000361445
  CDS Start-End: 78-7727
ggggcctgaagcggcggtaccggtgctggcggcggcagctgaggccttggccgaagccgcgcgaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggatgccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaacgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcgatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtgtggtttgaccgaagaaccaattatacccgttctttagcggtcatgtcaatggttgggtatattttaggcctgggagatagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccacgtaaatcaagccattcattttggggaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacata

SEQ ID NO: 152111 - DNA, 4017 bp, Homo sapiens
  Payload ID: 9934
  Gene Symbol: MTOR
  Gene Name: mechanistic target of rapamycin (serine/threonine kinase)
  ENST ID: ENST00000376838
  CDS Start-End: 803-3067
ctttctctgtcaggctcctatgctcttcatgtcttcctttgtccactatctggtgacctgtcaaaactttgctcccttgaaatattgtgatgactgctgcttgcccccacttctgcttgccatttctgctctcccctaaatgtacactttatacccagtgcagctctgctttctgggtgaaagtgccagccctgtgcctgctccaggcgtgctttgctggcctcgctctcactcctcgcctgcatgtatcccctgcacggtcacattcatgggcttgtttcccgtgaaccaatctgcacatctctggccttattcttcccccttgccaagtagtccccaccgctgccttcttgtttccctccttgcccttctgcagctctcttccagacctaccccaaatccctcttcttgacaaagctttccaaatgcctgtccttgctactcccattgtgccttgcagagtacctaggtcttcaggtttgtgcgtgagctcccctaggaggccgggagatcccttgaggcaagagctctctcctgctcctcttgctgtgcccttctcgcagtgcactcatagtacgttatatagttagtgctccacaaagtgagtggatcatgttgaatttagtaaaacagccatttctgagtgtctccttgaagtgtttgctttatggacacacagaacaggcaggagcagctgttcctcagcatcgaccttgcgctcctctgagccctgctgttggtcacagctccagtgtctgtccttgcctttctccccaaccaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtgtggtttgaccgaagaaccaattatacccgttctttagcggtcatgtcaatggttgggtatattttaggcctgggagatagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccacgtaaatcaagccattcattttggggaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacata

SEQ ID NO: 152112 - DNA, 694 bp, Homo sapiens
  Payload ID: 9934
  Gene Symbol: MTOR
  Gene Name: mechanistic target of rapamycin (serine/threonine kinase)
  ENST ID: ENST00000455339
  CDS Start-End: 212-694
cctggaacagtacttaaacaagggagcgtgctgtgtgttccagtaaaactggacttgcagaagtggaggtggaggggctggattggctgagggctatcgtttgccaactcctagcttacagtatcacgtacttattgattttttcatccgttatctctgttgatccctccctgatctgtcttctgtttctcaaagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcga

SEQ ID NO: 152113 - DNA, 2091 bp, Homo sapiens
  Payload ID: 9935
  Gene Symbol: MKS1
  Gene Name: Meckel syndrome, type 1
  ENST ID: ENST00000313863
  CDS Start-End: 3-1373
tcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccagggccttcatggaatcgagctcccttcagaaaaggatgcggagtgtgttggaccgtctggaagggttcagccagcagagttccattcacaatgtgctagaggccttccgtcgagcccggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagctgtttggggtgaccccatagtgagtctggccttgactcacttttctggcttgtctcacagtagcaggggatctgctgttctccaccctttaaaaatggagcctttcatcttccaagaccaaagaaggaaggaaggtggacggtgagagggtcttaaatccccagcctgtgagtctcagcctctttccagggaagcctcattctactgcttggggcttgctgaggttgagatatgagttatttctgagtaagtgaaggctgaaggcagtgctgagtcctttctgctagctgggtggtatcttttactgtgtttttttgtttgtttgtttttttgttttttgttacataaaccc

SEQ ID NO: 152114 - DNA, 2397 bp, Homo sapiens
  Payload ID: 9935
  Gene Symbol: MKS1
  Gene Name: Meckel syndrome, type 1
  Uniprot ID: Q9NXB0
  ENST ID: ENST00000393119
  CDS Start-End: 76-1755
ccgatccagcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggctcacacaccctgacagtctccacgtggagacctgtggagcttggcacggtggctgagctgaggaggtttttcattggcggttctctggaactggaggacctctcctatgtacggataccaggatccttcaagggggaacgcctgagccgctttggactccgcacagagaccacaggcactgtcaccttccgcttgcactgtctgcagcagtccagggccttcatggaatcgagctcccttcagaaaaggatgcggagtgtgttggaccgtctggaagggttcagccagcagagttccattcacaatgtgctagaggccttccgtcgagcccggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagctgtttggggtgaccccatagtgagtctggccttgactcacttttctggcttgtctcacagtagcaggggatctgctgttctccaccctttaaaaatggagcctttcatcttccaagaccaaagaaggaaggaaggtggacggtgagagggtcttaaatccccagcctgtgagtctcagcctctttccagggaagcctcattctactgcttggggcttgctgaggttgagatatgagttatttctgagtaagtgaaggctgaaggcagtgctgagtcctttctgctagctgggtggtatcttttactgtgtttttttgtttgtttgtttttttgttttttgttacataaaccccttttattttgactga

SEQ ID NO: 152115 - DNA, 1926 bp, Homo sapiens
  Payload ID: 9935
  Gene Symbol: MKS1
  Gene Name: Meckel syndrome, type 1
  ENST ID: ENST00000393120
  CDS Start-End: 7-501
gctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggctcacacaccctgacagtctccacgtggagacctgtggagcttggcacggtggctgagctgaggaggtttttcattggcggttctctggaactggaggacctctcctatgtacggataccaggatccttcaagggggaacgcctgagccgctttggactccgcacagagaccacaggcactgtcaccttccgcttgcactgtctgcagcagtccagggccttcatggaatcgagctcccttcagaaaaggatgcggagtgtgttggaccgtctggaagggttcagccagcagagttccattcacaatgtgctagaggccttccgtcgagcccggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagctgtttggggtgaccccatagtgagtctggccttgactcacttttctggcttgtctcacagtagc

SEQ ID NO: 152116 - DNA, 2083 bp, Homo sapiens
  Payload ID: 9935
  Gene Symbol: MKS1
  Gene Name: Meckel syndrome, type 1
  Uniprot ID: Q9NXB0
  ENST ID: ENST00000537529
  CDS Start-End: 95-1744
agtgtggcatggtggaaaaggtagagggcgaagactcaggccacctggtccccgtcatcatttctgcatctatctgtctatatgaagtgggctgatggctgtgccagtttcctcatttgcacagcgcacgaggtcccgctttcgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggctcacacaccctgacagtctccacgtggagacctgtggagcttggcacggtggctgagctgaggaggtttttcattggcggttctctggaactggaggacctctcctatgtacggataccaggatccttcaagggggaacgcctgagccgctttggactccgcacagagaccacaggcactgtcaccttccgcttgcactgtctgcagcagtccagggccttcatggaatcgagctcccttcagaaaaggatgcggagtgtgttggaccgtctggaagggttcagccagcagagttccattcacaatgtgctagaggccttccgtcgagcccggcgccgcatgcaggaggcccgggaaagcctcccgcaggacctagtgagcccctctggaaccctggtctcctagctcacagcagccctggcccacagtgcaagaggacaagatgggggatatctgaggccagtgctctcctgcctcttcgtctttctgattagagaccacgttggtctgctgagaaccagaaaagctgggaaattcccggctggcccctctgcctagccttctgcagggtcttctccctaccctgtggaaataaagccagagaccctgtggccccccctttatatttgcagccactgtcaatgggcatcacagcaaggcaggctttttgatctgaagctgtttggggtgaccccatagtgagtctggccttgactcacttttctggcttgtctcacagtagca

SEQ ID NO: 152117 - DNA, 812 bp, Homo sapiens
  Payload ID: 9935
  Gene Symbol: MKS1
  Gene Name: Meckel syndrome, type 1
  ENST ID: ENST00000581761
  CDS Start-End: 16-381
cgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccacactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctc

SEQ ID NO: 152118 - DNA, 495 bp, Homo sapiens
  Payload ID: 9935
  Gene Symbol: MKS1
  Gene Name: Meckel syndrome, type 1
  ENST ID: ENST00000577315
  CDS Start-End: 1-352
tggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccagcgacaatgacgtggccttggcactgacttcctgacagtctctccatgtgcttcatgctcctctgattggactcagggtgagaagctgtatggcaaaattggctcatagcatatgtgtattgaatgaatcagcattcagtttggaataaaagcatctgtcttttactgtg

SEQ ID NO: 152119 - DNA, 568 bp, Homo sapiens
  Payload ID: 9935
  Gene Symbol: MKS1
  Gene Name: Meckel syndrome, type 1
  ENST ID: ENST00000578789
  CDS Start-End: 24-170
agtcgcggcgcgtcgcagctgtcatggcggagaccgtctggagcactgacaccggggaggcagtgtatcgctcccgggaccccgtgcgcaacttgcgcctccggtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctata

SEQ ID NO: 152120 - DNA, 843 bp, Homo sapiens
  Payload ID: 9935
  Gene Symbol: MKS1
  Gene Name: Meckel syndrome, type 1
  ENST ID: ENST00000580127
  CDS Start-End: 76-516
ccgatccagcgtctccgttgccaggaaaacagagcggcgcgctttccggcgcagtcgcggcgcgtcgcagctgtcatggcggagaccgtctggagcactgacaccggggaggcagtgtatcgctcccgggaccccgtgcgcaacttgcgcctccgagtccacctgcaaagaatcacatcaagcaactttcttcattatcagcctgctgccgagctcgggaaggacctcatagacttggccacttttaggcctcagccaactgccagtggacaccgcccagaggaagacgaagaggaggagattgtgattgggtggcaggagaagctctttagccagtttgaagtagatctgtaccaaaatgaaacagcctgtcagagtcctttggattatcagtaccgtcaggagatcctgaagctggagaattcgggtggcaagaaaaaccgacgaatctttacctacactgactctgatagatacaccaatttggaggaggtacttggctccatgtggccctgaccagatggcgtacacagggctgcttgcttttcccagcactgtcagagaatgaccactgcagccagcgaggtgccttcattcttggtcgagcgaatggcaaatgtcaggcgtcgccggcaggacaggcgagggatggagggcggcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatc

SEQ ID NO: 152121 - DNA, 1158 bp, Homo sapiens
  Payload ID: 9935
  Gene Symbol: MKS1
  Gene Name: Meckel syndrome, type 1
  ENST ID: ENST00000577824
  CDS Start-End: 1-686
gcatcctcaagtcacgcatcgtcacctgggagccctcagaagagtttgtcaggaacaaccacgtcattaacacccctcttcagacaatgcacatcatggcagacctggggccctataaaaagcttggctataagaagtatgaacatgtcctgtgtactctgaaggtggatagcaatggtgtgatcacagtaaagcctgacttcacgggcctcaaaggaccctacaggattgagacggagggggagaagcaggagctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatgataaccttgtcattggccacaaggagaacagattccaagggaggccttgcccaccctatgacactcctttttataggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggtaaccgctcgtctctgcccttctgtggcccacatgccctaggccctaagaacaagactaacactcgaatgcttctggtgaggggtggagataattgggaattggaaatgtttggcttgaaagagttcctgttcctctgaggactttctgcccccctccattagcgacaatgacgtggccttggcactgacttcctgacagtctctccatgtgcttcatgctcctctgattggactcagggtgagaagctgtatggcaaaattggctcatagcatatgtgtattgaatgaatcagcattcagtttggaataaaagcatctgtcttttactgt

SEQ ID NO: 152122 - DNA, 824 bp, Homo sapiens
  Payload ID: 9935
  Gene Symbol: MKS1
  Gene Name: Meckel syndrome, type 1
  ENST ID: ENST00000585134
  CDS Start-End: 1-636
ctgtggaaatatacgatcgacaatgtttccccccacgcacagccggaggaggaggagcgggaacggcgagtgttcaaggatctttatggccggcacaaggagtatctcagcagcctcgtaggcaccgactttgagatgactgtcccaggtgccctccggctctttgtaaatggagaggtcgtttcagcccaaggctatgagtatgacaatctctacgtccacttctttgtagaattgccaactgctcactggtcaagcccagcattccagcagctctcaggagtaacacagacctgcaccaccaagtccctggcaatggacaaggtggctcacttctcctacccattcacgtttgaagccttcttcctccatgaggatgaatcttctgatgcactcccggagtggcctgtgctctactgtgaggtcctctcgctggacttctggcagaggtaccgtgtggaaggctatggggctgtggtgctgcctgccactccaggtaaccgctcgtctctgcccttctgtggcccacatgccctaggccctaagaacaagactaacactcgaatgcttctggtgaggggtggagataattgggaattggaaatgtttggcttgaaagagttcctgttcctctgaggactttctgcccccctccattagcgacaatgacgtggccttggcactgacttcctgacagtctctccatgtgcttcatgctcctctgattggactcagggtgagaagctgtatggcaaaattggctcatagcatatgtgtattgaatgaatcagcattcagtttggaataaaagcatctgtctttta

SEQ ID NO: 152123 - DNA, 5844 bp, Homo sapiens
  Payload ID: 9936
  Gene Symbol: MED1
  Gene Name: mediator complex subunit 1
  Uniprot ID: Q15648
  ENST ID: ENST00000300651
  CDS Start-End: 225-4970
acggtttatctcgcgaattttgggaagttccgttggggaagatggcggcggcctcgagcacccttctcttcttgccgccggggacttcagattgatccttcccgggaagagtagggactgctggtgccctgcgtcccgggatcccgagccaacttgtttcctccgttagtggtggggaagggcttatccttttgtggcggatctagcttctcctcgccttcaggatgaaagctcagggggaaaccgaggagtcagaaaagctgagtaagatgagttctctcctggaacggctccatgcaaaatttaaccaaaatagaccctggagtgaaaccattaagcttgtgcgtcaagtcatggagaagagggttgtgatgagttctggagggcatcaacatttggtcagctgtttggagacattgcagaaggctctcaaagtaacatctttaccagcaatgactgatcgtttggagtccatagcaagacagaatggactgggctctcatctcagtgccagtggcactgaatgttacatcacgtcagatatgttctatgtggaagtgcagttagatcctgcaggacagctttgtgatgtaaaagtggctcaccatggggagaatcctgtgagctgtccggagcttgtacagcagctaagggaaaaaaattttgatgaattttctaagcaccttaagggccttgttaatctgtataaccttccaggggacaacaaactgaagactaaaatgtacttggctctccaatccttagaacaagatctttctaaaatggcaattatgtactggaaagcaactaatgctggtcccttggataagattcttcatggaagtgttggctatctcacaccaaggagtgggggtcatttaatgaacctgaagtactatgtctctccttctgacctactggatgacaagactgcatctcccatcattttgcatgagaataatgtttctcgatctttgggcatgaatgcatcagtgacaattgaaggaacatctgctgtgtacaaactcccaattgcaccattaattatggggtcacatccagttgacaataaatggaccccttccttctcctcaatcaccagtgccaacagtgttgatcttcctgcctgtttcttcttgaaatttccccagccaatcccagtatctagagcatttgttcagaaactgcagaactgcacaggaattccattgtttgaaactcaaccaacttatgcacccctgtatgaactgatcactcagtttgagctatcaaaggaccctgaccccatacctttgaatcacaacatgagattttatgctgctcttcctggtcagcagcactgctatttcctcaacaaggatgctcctcttccagatggccgaagtctacagggaacccttgttagcaaaatcacctttcagcaccctggccgagttcctcttatcctaaatctgatcagacaccaagtggcctataacaccctcattggaagctgtgtcaaaagaactattctgaaagaagattctcctgggcttctccaatttgaagtgtgtcctctctcagagtctcgtttcagcgtatcttttcagcaccctgtgaatgactccctggtgtgtgtggtaatggatgtgcaggactcaacacatgtgagctgtaaactctacaaagggctgtcggatgcactgatctgcacagatgacttcattgccaaagttgttcaaagatgtatgtccatccctgtgacgatgagggctattcggaggaaagctgaaaccattcaagccgacaccccagcactgtccctcattgcagagacagttgaagacatggtgaaaaagaacctgcccccggctagcagcccagggtatggcatgaccacaggcaacaacccaatgagtggtaccactacaccaaccaacacctttccggggggtcccattaccaccttgtttaatatgagcatgagcatcaaagatcggcatgagtcggtgggccatggggaggacttcagcaaggtgtctcagaacccaattcttaccagtttgttgcaaatcacagggaacggggggtctaccattggctcgagtccgacccctcctcatcacacgccgccacctgtctcttcgatggccggcaacaccaagaaccacccgatgctcatgaaccttcttaaagataatcctgcccaggatttctcaaccctttatggaagcagccctttagaaaggcagaactcctcttccggctcaccccgcatggaaatatgctcggggagcaacaagaccaagaaaaagaagtcatcaagattaccacctgagaaaccaaagcaccagactgaagatgactttcagagggagctattttcaatggatgttgactcacagaaccctatctttgatgtcaacatgacagctgacacgctggatacgccacacatcactccagctccaagccagtgtagcactcccccaacaacttacccacaaccagtacctcacccccaacccagtattcaaaggatggtccgactatccagttcagacagcattggcccagatgtaactgacatcctttcagacattgcagaagaagcttctaaacttcccagcactagtgatgattgcccagccattggcacccctcttcgagattcttcaagctctgggcattctcagagtaccctgtttgactctgatgtctttcaaactaacaataatgaaaatccatacactgatccagctgatcttattgcagatgctgctggaagccccagtagtgactctcctaccaatcatttttttcatgatggagtagatttcaatcctgatttattgaacagccagagccaaagtggttttggagaagaatattttgatgaaagcagccaaagtggggataatgatgatttcaaaggatttgcatctcaggcactaaatactttgggggtgccaatgcttggaggtgataatggggagaccaagtttaagggcaataaccaagccgacacagttgatttcagtattatttcagtagccggcaaagctttagctcctgcagatcttatggagcatcacagtggtagtcagggtcctttactgaccactggggacttagggaaagaaaagactcaaaagagggtaaaggaaggcaatggcaccagtaatagtactctctcggggcccggattagacagcaaaccagggaagcgcagtcggaccccttctaatgatgggaaaagcaaagataagcctccaaagcggaagaaggcagacactgagggaaagtctccatctcatagttcttctaacagaccttttaccccacctaccagtacaggtggatctaaatcgccaggcagtgcaggaagatctcagactcccccaggtgttgccacaccacccattcccaaaatcactattcagattcctaagggaacagtgatggtgggcaagccttcctctcacagtcagtataccagcagtggttctgtgtcttcctcaggcagcaaaagccaccatagccattcttcctcctcttcctcatctgcttccacctcagggaagatgaaaagcagtaaatcagaaggttcatcaagttccaagttaagtagcagtatgtattctagccaggggtcttctggatctagccagtccaaaaattcatcccagtctggggggaagccaggctcctctcccataaccaagcatggactgagcagtggctctagcagcaccaagatgaaacctcaaggaaagccatcatcacttatgaatccttctttaagtaaaccaaacatatccccttctcattcaaggccacctggaggctctgacaagcttgcctctccaatgaagcctgttcctggaactcctccatcctctaaagccaagtcccctatcagttcaggttctggtggttctcatatgtctggaactagttcaagctctggcatgaagtcatcttcagggttaggatcctcaggctcgttgtcccagaaaactcccccatcatctaattcctgtacggcatcttcctcctccttttcctcaagtggctcttccatgtcatcctctcagaaccagcatgggagttctaaaggaaaatctcccagcagaaacaagaagccgtccttgacagctgtcatagataaactgaagcatggggttgtcaccagtggccctgggggtgaagacccactggacggccagatgggggtgagcacaaattcttccagccatcctatgtcctccaaacataacatgtcaggaggagagtttcagggcaagcgtgagaaaagtgataaagacaaatcaaaggtttccacctccgggagttcagtggattcttctaagaagacctcagagtcaaaaaatgtggggagcacaggtgtggcaaaaattatcatcagtaagcatgatggaggctcccctagcattaaagccaaagtgactttgcagaaacctggggaaagtagtggagaagggcttaggcctcaaatggcttcttctaaaaactatggctctccactcatcagtggttccactccaaagcatgagcgtggctctcccagccatagtaagtcaccagcatataccccccagaatctggacagtgaaagtgagtcaggctcctccatagcagagaaatcttatcagaatagtcccagctcagacgatggtatccgaccacttccagaatacagcacagagaaacataagaagcacaaaaaggaaaagaagaaagtaaaagacaaagatagggaccgagaccgggacaaagaccgagacaagaaaaaatctcatagcatcaagccagagagttggtccaaatcacccatctcttcagaccagtccttgtctatgacaagtaacacaatcttatctgcagacagaccctcaaggctcagcccagactttatgattggggaggaagatgatgatcttatggatgtggccctgattgggaattaggaaccttatttcctaaaagaaacagggccagaggaaaaaaaactattgataagtttataggcaaaccaccataaggggtgagtcagacaggtctgatttggttaagaatcctaaatggcatggctttgacatcaagctgggtgaattagaaaggcatatccagaccctattaaagaaaccacagggtttgattctggttaccaggaagtcttctttgttcctgtgccagaaagaaagttaaaatacttgcttaagaaagggaggggggtgggaggggtgtagggagagggaagggagggaaacagttttgtgggaaatattcatatatattttcttctccctttttccatttttaggccatgttttaaactcattttagtgcatgtatatgaagggctgggcagaaaatgaaaaagcaatacattccttgatgcatttgcatgaaggttgttcaactttgtttgaggtagttgtccgtttgagtcatgggcaaatgaaggactttggtcattttggacacttaagtaatgtttggtgtctgtttcttaggagtgactgggggagggaagattattttagctatttatttgtaatattttaaccctttatctgtttgtttttatacagtgtttcgttctaaatctatgaggtttagggttcaaaatgatggaaggccgaagagcaaggcttatatggtggtagggagcttatagcttgtgctaatactgtagcatcaagcccaagcaaattagtcagagcccgcctttagagttaaatataatagaaaaaccaaaatgatatttttattttaggagggtttaaatagggttcagagatcataggaatattaggagttacctctctgtggaggtat

SEQ ID NO: 152124 - DNA, 2870 bp, Homo sapiens
  Payload ID: 9936
  Gene Symbol: MED1
  Gene Name: mediator complex subunit 1
  Uniprot ID: Q15648
  ENST ID: ENST00000394287
  CDS Start-End: 207-1877
tttgggaagttccgttggggaagatggcggcggcctcgagcacccttctcttcttgccgccggggacttcagattgatccttcccgggaagagtagggactgctggtgccctgcgtcccgggatcccgagccaacttgtttcctccgttagtggtggggaagggcttatccttttgtggcggatctagcttctcctcgccttcaggatgaaagctcagggggaaaccgaggagtcagaaaagctgagtaagatgagttctctcctggaacggctccatgcaaaatttaaccaaaatagaccctggagtgaaaccattaagcttgtgcgtcaagtcatggagaagagggttgtgatgagttctggagggcatcaacatttggtcagctgtttggagacattgcagaaggctctcaaagtaacatctttaccagcaatgactgatcgtttggagtccatagcaagacagaatggactgggctctcatctcagtgccagtggcactgaatgttacatcacgtcagatatgttctatgtggaagtgcagttagatcctgcaggacagctttgtgatgtaaaagtggctcaccatggggagaatcctgtgagctgtccggagcttgtacagcagctaagggaaaaaaattttgatgaattttctaagcaccttaagggccttgttaatctgtataaccttccaggggacaacaaactgaagactaaaatgtacttggctctccaatccttagaacaagatctttctaaaatggcaattatgtactggaaagcaactaatgctggtcccttggataagattcttcatggaagtgttggctatctcacaccaaggagtgggggtcatttaatgaacctgaagtactatgtctctccttctgacctactggatgacaagactgcatctcccatcattttgcatgagaataatgtttctcgatctttgggcatgaatgcatcagtgacaattgaaggaacatctgctgtgtacaaactcccaattgcaccattaattatggggtcacatccagttgacaataaatggaccccttccttctcctcaatcaccagtgccaacagtgttgatcttcctgcctgtttcttcttgaaatttccccagccaatcccagtatctagagcatttgttcagaaactgcagaactgcacaggaattccattgtttgaaactcaaccaacttatgcacccctgtatgaactgatcactcagtttgagctatcaaaggaccctgaccccatacctttgaatcacaacatgagattttatgctgctcttcctggtcagcagcactgctatttcctcaacaaggatgctcctcttccagatggccgaagtctacagggaacccttgttagcaaaatcacctttcagcaccctggccgagttcctcttatcctaaatctgatcagacaccaagtggcctataacaccctcattggaagctgtgtcaaaagaactattctgaaagaagattctcctgggcttctccaatttgaagtgtgtcctctctcagagtctcgtttcagcgtatcttttcagcaccctgtgaatgactccctggtgtgtgtggtaatggatgtgcaggactcaacacatgtgagctgtaaactctacaaagggctgtcggatgcactgatctgcacagatgacttcattgccaaagttgttcaaagatgtatgtccatccctgtgacgatgagggctattcggaggaaagctgaaaccattcaagccgacaccccagcactgtccctcattgcagagacagttgaagacatggtgaaaaagaacctgcccccggctagcagcccaggatcaaagaatcccgagttaggatctggatgaaggataagcccctgaattgtcgatgggctcacccccacactgacccagcatctgaacttgcttaacagggagccggggctaaactgcttcaccctgcctgagaaccagggagcactgcatttctccacagggtggaggagaagaggcagaataaaccaagcctgggacacctccctcctgtctaggtgtactcattcttctgtttcaaaagaaggcaaggacatgaagtcaacttctacctatcttctgctgctggtgtcttatgtattctcagtttgacctgattcctcttctgtcttttgacttaacattaggggttcttggtcataacctgctctgatgtacataaagatttcaggttcaatatcaatgtgtcttaaaacagaagtattttagcgggtggggggtggggtggtggggacaaacaacgcaggatataattgccaaaaccaggcttgaggttggtgactcttgaaagattttctttcttcaggcctagatcagaaaattaagtgcagcaatatcatgaattctcagaagccctttcagggagccagtgagtcatacagtatccacagttgagtcacttaaagatgtcagtatacgaaacattattcacaatccttgggcaatctcatttttttttccttctcccctcctcccctgccccccatacatttctatccttgagttagttttggaggggcaggaagtacttaacatctcagaagctagattgggaaacatgctcagctataagaactgagctttaaattttgagtttaaaaatgtacatcaggagcagctggggagggtctttttttaaaaaaatctttcaaatttggttttctgtgcatatggccgttttgtaaatactttggggtttttcatttttttgaaagtagatgaaatctgttgtgggatttttttcccgaaacattacaaaataacctgtttatttacatgcaaataaacttctttgataaaaagtaa

SEQ ID NO: 152125 - DNA, 580 bp, Homo sapiens
  Payload ID: 9936
  Gene Symbol: MED1
  Gene Name: mediator complex subunit 1
  ENST ID: ENST00000581334
  CDS Start-End: 211-450
gaattttgggaagttccgttggggaagatggcggcggcctcgagcacccttctcttcttgccgccggggacttcagattgatccttcccgggaagagtagggactgctggtgccctgcgtcccgggatcccgagccaacttgtttcctccgttagtggtggggaagggcttatccttttgtggcggatctagcttctcctcgccttcaggatgaaagctcagggggaaaccgaggagtcagaaaagctgagtaagatgagttctctcctggaacggctccatgcaaaatttaaccaaaatagaccctggagtgaaaccattaagcttgtgcgtcaagtcatgttttgcagattcagaaacctaattttattggtacatcaagattttatagagttttcatggctgggcgtggtggttcacatctgtaatcccagcactttgggaggctgaggcgggtcgatcacctgaggtcaggagttcgagaccaggctgaccaacaaggagaagagggttgtgatgagttctggagggcatcaacatttggtcagctgtttggagacattgcagaaggctctcaaag

SEQ ID NO: 152126 - DNA, 4584 bp, Homo sapiens
  Payload ID: 9936
  Gene Symbol: MED1
  Gene Name: mediator complex subunit 1
  ENST ID: ENST00000577831
  CDS Start-End: 211-504
gaattttgggaagttccgttggggaagatggcggcggcctcgagcacccttctcttcttgccgccggggacttcagattgatccttcccgggaagagtagggactgctggtgccctgcgtcccgggatcccgagccaacttgtttcctccgttagtggtggggaagggcttatccttttgtggcggatctagcttctcctcgccttcaggatgaaagctcagggggaaaccgaggagtcagaaaagctgagtaagatgagttctctcctggaacggctccatgcaaaatttaaccaaaatagaccctggagtgaaaccattaagcttgtgcgtcaagtcatggagaagagggttgtgatgagttctggagggcatcaacatttggtcagctgtttggagacattgcagaaggctctcaaagtaacatctttaccagcaatgactgatcgtttggagtccatagcaagacagaatggagctgtccggagcttgtacagcagctaagggaaaaaaattttgatgaattttctaagcaccttaagggccttgttaatctgtataaccttccaggggacaacaaactgaagactaaaatgtacttggctctccaatccttagaacaagatctttctaaaatggcaattatgtactggaaagcaactaatgctggtcccttggataagattcttcatggaagtgttggctatctcacaccaaggagtgggggtcatttaatgaacctgaagtactatgtctctccttctgacctactggatgacaagactgcatctcccatcattttgcatgagaataatgtttctcgatctttgggcatgaatgcatcagtgacaattgaaggaacatctgctgtgtacaaactcccaattgcaccattaattatggggtcacatccagttgacaataaatggaccccttccttctcctcaatcaccagtgccaacagtgttgatcttcctgcctgtttcttcttgaaatttccccagccaatcccagtatctagagcatttgttcagaaactgcagaactgcacaggaattccattgtttgaaactcaaccaacttatgcacccctgtatgaactgatcactcagtttgagctatcaaaggaccctgaccccatacctttgaatcacaacatgagattttatgctgctcttcctggtcagcagcactgctatttcctcaacaaggatgctcctcttccagatggccgaagtctacagggaacccttgttagcaaaatcacctttcagcaccctggccgagttcctcttatcctaaatctgatcagacaccaagtggcctataacaccctcattggaagctgtgtcaaaagaactattctgaaagaagattctcctgggcttctccaatttgaagtgtgtcctctctcagagtctcgtttcagcgtatcttttcagcaccctgtgaatgactccctggtgtgtgtggtaatggatgtgcaggactcaacacatgtgagctgtaaactctacaaagggctgtcggatgcactgatctgcacagatgacttcattgccaaagttgttcaaagatgtatgtccatccctgtgacgatgagggctattcggaggaaagctgaaaccattcaagccgacaccccagcactgtccctcattgcagagacagttgaagacatggtgaaaaagaacctgcccccggctagcagcccagggtatggcatgaccacaggcaacaacccaatgagtggtaccactacaccaaccaacacctttccggggggtcccattaccaccttgtttaatatgagcatgagcatcaaagatcggcatgagtcggtgggccatggggaggacttcagcaaggtgtctcagaacccaattcttaccagtttgttgcaaatcacagggaacggggggtctaccattggctcgagtccgacccctcctcatcacacgccgccacctgtctcttcgatggccggcaacaccaagaaccacccgatgctcatgaaccttcttaaagataatcctgcccaggatttctcaaccctttatggaagcagccctttagaaaggcagaactcctcttccggctcaccccgcatggaaatatgctcggggagcaacaagaccaagaaaaagaagtcatcaagattaccacctgagaaaccaaagcaccagactgaagatgactttcagagggagctattttcaatggatgttgactcacagaaccctatctttgatgtcaacatgacagctgacacgctggatacgccacacatcactccagctccaagccagtgtagcactcccccaacaacttacccacaaccagtacctcacccccaacccagtattcaaaggatggtccgactatccagttcagacagcattggcccagatgtaactgacatcctttcagacattgcagaagaagcttctaaacttcccagcactagtgatgattgcccagccattggcacccctcttcgagattcttcaagctctgggcattctcagagtaccctgtttgactctgatgtctttcaaactaacaataatgaaaatccatacactgatccagctgatcttattgcagatgctgctggaagccccagtagtgactctcctaccaatcatttttttcatgatggagtagatttcaatcctgatttattgaacagccagagccaaagtggttttggagaagaatattttgatgaaagcagccaaagtggggataatgatgatttcaaaggatttgcatctcaggcactaaatactttgggggtgccaatgcttggaggtgataatggggagaccaagtttaagggcaataaccaagccgacacagttgatttcagtattatttcagtagccggcaaagctttagctcctgcagatcttatggagcatcacagtggtagtcagggtcctttactgaccactggggacttagggaaagaaaagactcaaaagagggtaaaggaaggcaatggcaccagtaatagtactctctcggggcccggattagacagcaaaccagggaagcgcagtcggaccccttctaatgatgggaaaagcaaagataagcctccaaagcggaagaaggcagacactgagggaaagtctccatctcatagttcttctaacagaccttttaccccacctaccagtacaggtggatctaaatcgccaggcagtgcaggaagatctcagactcccccaggtgttgccacaccacccattcccaaaatcactattcagattcctaagggaacagtgatggtgggcaagccttcctctcacagtcagtataccagcagtggttctgtgtcttcctcaggcagcaaaagccaccatagccattcttcctcctcttcctcatctgcttccacctcagggaagatgaaaagcagtaaatcagaaggttcatcaagttccaagttaagtagcagtatgtattctagccaggggtcttctggatctagccagtccaaaaattcatcccagtctggggggaagccaggctcctctcccataaccaagcatggactgagcagtggctctagcagcaccaagatgaaacctcaaggaaagccatcatcacttatgaatccttctttaagtaaaccaaacatatccccttctcattcaaggccacctggaggctctgacaagcttgcctctccaatgaagcctgttcctggaactcctccatcctctaaagccaagtcccctatcagttcaggttctggtggttctcatatgtctggaactagttcaagctctggcatgaagtcatcttcagggttaggatcctcaggctcgttgtcccagaaaactcccccatcatctaattcctgtacggcatcttcctcctccttttcctcaagtggctcttccatgtcatcctctcagaaccagcatgggagttctaaaggaaaatctcccagcagaaacaagaagccgtccttgacagctgtcatagataaactgaagcatggggttgtcaccagtggccctgggggtgaagacccactggacggccagatgggggtgagcacaaattcttccagccatcctatgtcctccaaacataacatgtcaggaggagagtttcagggcaagcgtgagaaaagtgataaagacaaatcaaaggtttccacctccgggagttcagtggattcttctaagaagacctcagagtcaaaaaatgtggggagcacaggtgtggcaaaaattatcatcagtaagcatgatggaggctcccctagcattaaagccaaagtgactttgcagaaacctggggaaagtagtggagaagggcttaggcctcaaatggcttcttctaaaaactatggctctccactcatcagtggttccactccaaagcatgagcgtggctctcccagccatagtaagtcaccagcatataccccccagaatctggacagtgaaagtgagtcaggctcctccatagcagagaaatcttatcagaatagtcccagctcagacgatggtatccgaccacttccagaatacagcacagagaaacataagaagcacaaaaagg

SEQ ID NO: 152127 - DNA, 1141 bp, Homo sapiens
  Payload ID: 9937
  Gene Symbol: MED10
  Gene Name: mediator complex subunit 10
  Uniprot ID: Q9BTT4
  ENST ID: ENST00000255764
  CDS Start-End: 112-519
cagaggaaacggaagtcgtatctgtccggacggaagcaggaagcgggagcgtagggccacgcctgcggcgctgctggttgaggctgtgtgggtcggggacgggccgaggcgatggcggagaagtttgaccacctagaggagcacctggagaagttcgtggagaacattcggcagctcggcatcatcgtcagtgacttccagcccagcagccaggccgggctcaaccaaaagctgaattttattgttactggcttacaggatattgacaagtgcagacagcagcttcatgatattactgtaccgttagaagtttttgaatatatagatcaaggtcgaaatccccagctctacaccaaagagtgcctggagagggctctagctaaaaatgagcaagttaaaggcaagatcgacaccatgaagaaatttaaaagcctgttgattcaagaactttctaaagtatttccggaagacatggctaagtatcgaagcatccggggggaggatcacccgccttcttaaccagctcaccctccctgtgtgaagatcccctgggactgcgatgcggcgtgaggctgggactgcgagtgctgacgccaccttcctgctgaggtgggactgggccctggacacacccctcagcccctctgtcctcattgtttggcctcatgggaccgaggggctggaggagaggcggagctgtgccccagctgttccagcagcttgtctggcgtcaactggctttcagagtgctgacccctcatcactgtggggatcattctctctgagggcagatgaggcgcaggaaaatagtcttggaaatgttaaatatgatgggtaaattaaaagttttacaacattctacctaatatttttcttttaacatactctttctgttctattgtattatggtgtccgaaagctaaataacgactaggaaaaatttttttaaaaaaagaaaaatcagtttaatgtgggaagtacttaagtggtattatattttacattttcaagtatagtgcataaagaatgttttaaatgtaactgttttcatggatttcaattagacatgcctataataaactaagtatgtggcttattccatgtaattatttttgtaatataatacaatgtgtcttgtaaa

SEQ ID NO: 152128 - DNA, 833 bp, Homo sapiens
  Payload ID: 9938
  Gene Symbol: MED11
  Gene Name: mediator complex subunit 11
  Uniprot ID: Q9P086
  ENST ID: ENST00000293777
  CDS Start-End: 57-410
ggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggtactgtgatcctagaattgtccaaggaaaaaactaacgagcggctcctagaccggcaggcggcggccttcaccgcttcagtgcaacacgtggaggcggagctgtcagctcagatccgctacctcacccaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacagaacctgggaacatgtagggtggggagtatgagcaccaacataccctgctggtcaaagtaccctaggacaaaggggcaaatggtgggcatggaaaaactgaagcccgagcctgcccacagctatgctttggcctctccagcagggtgctcctgctctgcactccagaaacaccctgacaggctcagagaggagatggaaactgacatacccaacccacttcctcaaacacttcatgctgctgccccagccttcccgcagacttggcctaatgaaaatacatacttcttcattcggagagacaaaacaagaactagagttttaatgataataaaagcaataataataaaagcaataacaataaaaacaa

SEQ ID NO: 152129 - DNA, 802 bp, Homo sapiens
  Payload ID: 9938
  Gene Symbol: MED11
  Gene Name: mediator complex subunit 11
  ENST ID: ENST00000573708
  CDS Start-End: 60-341
tccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggtactgtgatcctagaattgtccaaggaaaaaactaacgagcggctcctagaccggcaggcggcggccttcaccgcttcagtgcaacacgtggaggcggagctgtcagctcagatccgctacctcacccaggtcggtgtgtctggggggttctgcgagcgaaccccagctctgggtcaaagcctcaggcttgggtgatccagggtggagcattaactgggcaggaccagacctccccagccggccatccagagcgggtttcttcctctaaaaggaaagaatgggccgggcgcagtggcttgacagagttcgagaccagcctggccaacacggtgaaacctcgtctctactaaaaatataaaaattaggccaggctcggtggctcactcctgtaatcccagcactttgggaggctgaggcgggtggatcatctgaggtcaggagttcgagaccagcctggccaacatggtgaaactccgtctctactaaaaatacaaaaattagctgggctggtagcgggcacctgtaatcccagctacttggaagggtgaggcaggagaatcgcttgaacccaggaggtggaggttgcagtgagccaagattgcagcactgcactccagcctgggtgacaaagcaagactgtctcaaaaaaaaaaaaa

SEQ ID NO: 152130 - DNA, 652 bp, Homo sapiens
  Payload ID: 9938
  Gene Symbol: MED11
  Gene Name: mediator complex subunit 11
  ENST ID: ENST00000575284
  CDS Start-End: 63-320
acttccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggtactgtgatcctagaattgtccaaggaaaaaactaacgagcggctcctagaccggcaggcggcggccttcaccgcttcagtgcaacacgtggaggcggagctgtcagctcagatccgctacctcacccagctaccagatggcctaacaaattcaaactcagggaagaaatgagacgagacctgatgcctggttggagttagggtaaaggagatggtgctccattgatagtctgtcttgtaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacagaacctgggaacatgtagggtggggagtatgagcaccaacataccctgctggtcaaagtaccctaggaca

SEQ ID NO: 152131 - DNA, 6977 bp, Homo sapiens
  Payload ID: 9939
  Gene Symbol: MED12
  Gene Name: mediator complex subunit 12
  ENST ID: ENST00000333646
  CDS Start-End: 659-6742
attgtccgatggttcccggcgtacctcggcttccctcggtagtttccggcaatggtcgagagtttctaacgtgcccccttgttgtctctcggccgccgtcctctcaaccaccgccccccttttcggctccctctcccccttcccgttcccccagtcagcctggccctgctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccaggcaaagatacagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggg

SEQ ID NO: 152132 - DNA, 6795 bp, Homo sapiens
  Payload ID: 9939
  Gene Symbol: MED12
  Gene Name: mediator complex subunit 12
  Uniprot ID: Q93074
  ENST ID: ENST00000374080
  CDS Start-End: 33-6566
gctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgc

SEQ ID NO: 152133 - DNA, 6827 bp, Homo sapiens
  Payload ID: 9939
  Gene Symbol: MED12
  Gene Name: mediator complex subunit 12
  Uniprot ID: Q93074
  ENST ID: ENST00000374102
  CDS Start-End: 61-6591
ttcccgttcccccagtcagcctggccctgctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaaggga

SEQ ID NO: 152134 - DNA, 389 bp, Homo sapiens
  Payload ID: 9939
  Gene Symbol: MED12
  Gene Name: mediator complex subunit 12
  ENST ID: ENST00000429213
  CDS Start-End: 1-389
ggaccccaaacagaaggaggaaaaaacaactaaacgccgctttcctgcctcaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtac

SEQ ID NO: 152135 - DNA, 752 bp, Homo sapiens
  Payload ID: 9939
  Gene Symbol: MED12
  Gene Name: mediator complex subunit 12
  ENST ID: ENST00000444034
  CDS Start-End: 1-752
aggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcag

SEQ ID NO: 152136 - DNA, 6401 bp, Homo sapiens
  Payload ID: 9940
  Gene Symbol: MED12L
  Gene Name: mediator complex subunit 12-like
  ENST ID: ENST00000273432
  CDS Start-End: 34-5463
tctcattcatttcgccggttaacatgagagatcatggccgccttcgggcttctcagctatgagcagagaccgctgaagcgcccccggctcgggccgcccgacgtctacccacaggaccccaagcagaaggaggatgaacttactgctgtgaatgtaaagcaaggcttcaataatcagccagccttcactggagatgaacatggctcagccagaaatattgtaattaacccatcaaagattggagcttattttagcagcatattagctgagaaactgaagcttaacactttccaggacacgggaaagaagaaaccacaagttaatgctaaagataattattggctggttactgctcgatcccagagtgcaattcatagttggttttctgacttagcaggaaataagccactttctattttggcaaaaaaggttcctatccttagtaaaaaagaggatgtttttgcatatttagctaaatattctgtgccaatggttcgagcaacgtggctgatcaagatgacttgtgcctattattctgctatatctgaagctaaaattaagaaacgtcaggctcctgatccgaatttggagtggacacagatatctaccagatatcttcgagagcagttggccaagatttctgacttttaccacatggcctccagcacgggcgatggccctgtccctgtgccaccagaggtggagcaagccatgaagcaatgggaatacaacgaaaagctagcatttcacatgttccaggaaggaatgttagaaaaacacgaatatttgacatggatcctggatgttttagaaaagatcagaccaatggatgatgatcttcttaaactcttgctaccactaatgctgcaggttcgggcaaggatttatgaagtagaacaacagataaaacaaagaggccgtgcagtggaagttcggtggtcatttgacaagtgccaagaatccacagcaggggtgactattagtcgggttttgcacacgttggaagttttggatcgtcactgttttgaccgaactgattccagcaattccatggagacactttatcataagattttctgggcaaaccaaaacaaagataaccaagaggttgcgcccaacgatgaagctgtggtgacgctgttatgtgaatgggccgtgagctgcaaacggtctggcaagcacagggccatggctgtggcaaaactcctggagaagaggcaagcagaaattgaggcagagagatgtggtgaatcagaagtcttagatgagaaggagtctatttcttcatcctctcttgctggatccagtttgcctgttttccagaatgtgctgttaaggtttttagatacacaggccccctctttgtcggacccaaacagtgaatgtgaaaaggtggaatttgtgaacctggtgctgctcttctgcgagttcatccgccatgatgtcttctcccatgacgcatacatgtgtaccctcatatctcgaggagatttgtcagtcactgcctcaactcggccgcggtcaccagtaggggaaaatgcagatgaacactattcaaaggaccatgatgtgaaaatggagattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggatgaatcttcaagtcatgaatgtaaccagcgcacaatccttctctatggagtcggcaaagagcgtgatgaagcaaggcatcagctgaagaagattaccaaagatatcctgaaaattctaaataagaagagcaccacagagacaggggttggggacgaaggacaaaaagccaggaagaacaaacaggagacatttccaacactggagactgtgttcactaaactccagctcctttcatattttgatcaacatcaagtgacatctcagatttctaacaatgtgctagaacaaatcacaagctttgcgtcaggaacatcctatcatctccctttggctcaccacattcagctcatctttgatctcatggagccagcactgaacatcaacggactaattgacttcgcaatacagttactaaatgaactgagtgttgtggaagctgaactgctcctaaaatcctccagcctggcaggaagttatacaacaggactgtgtgtctgcatcgtggctgttctcaggcgctatcacagttgtctaatcttgaatcctgatcagacagcccaggtgtttgaagggttgtgtggtgtggtcaagcatgtcgtaaacccctcagaatgttcttcccctgaaagatgcattttagcctacctctatgatctctatgtgtcatgtagccacctcagaagtaaatttggagacctcttcagtagtgcctgttcaaaagtaaagcaaaccatatataataacgtgatgcctgcaaattcgaacttgcgatgggatccagacttcatgatggattttattgagaatccctcagcccgcagcatcaactactcaatgctgggcaagatcctcagtgacaatgcggccaatcgctacagctttgtctgcaatacactcatgaatgtatgtatgggccatcaggatgctggcaggattaacgacatagccaatttctcctctgagcttacggcttgctgcactgttcttagttcagaatggctgggggttctgaaggctctttgttgttcttcaaatcacgtgtgggggtttaatgatgtactttgcactgtagatgtgagtgacctttcattccatgattcattagctactttcattgctattctgatagcacgacagtgtttttccctggaggacgtcgtgcagcatgtcgcacttccctctcttctagcagcagcttgtggggatgcggacgccgagcctggggcgagaatgacatgccgactcttgcttcatctcttccgagctccccaggcctgcttcttacctcaagcaacgggcaaacctttccctggaataagatcatcttgtgatagacacctcttagccgctgctcacaacagcattgaagtgggagccgtgtttgctgtcttaaaagcaattatgatgcttggagatgccaaaattggcaataacagtgtcagctctttaaagaatgatgacttcaccatgagaggtttgcgatgtgatgggaatgctgatgatatctggactgcctcacaaaatccaaaatcctgtgggaaaagcatttccatagaaactgccaatttaagagaatacgctagatatgtactgaggactatctgtcaacaggaatgggtaggagagcattgcttaaaagaacctgaaagattatgtacagacaaagaacttatattggaccctgtgctttcaaatatgcaagcacagaaattactgcagcttatctgttatcctcatggcattaaagaatgtaccgagggggacaatctgcaaagacagcacattaagcgtattcttcagaatcttgagcagtggacactgaggcaatcctggttagaactccagctaatgatcaaacagtgcttgaaggaccctggctctggttctgtggccgaaatgaacaacttactggacaatattgcaaaggcaacaatagaggtattccagcagtctgcagacctaaataattcttctaattctggcatgagcctcttcaacccaaacagtattggaagtgctgatacaagtagcacgagacagaatggaataaagacattcctaagttcctccgaacgcaggggtgtatggttggtggcccccctcatcgccaggttgccaacttctgtgcaaggaagagtgctgaaagccgctggggaagagctggagaagggacagcacttgggttcttcttccaaaaaggaaagggacagacagaaacagaaaagtatgtctcttttgagtcaacaacccttcctctcactggtacttacctgccttaagggacaagatgaacaaagggaaggcctcctaacatctctccagaatcaagttaaccagattttaagtaactggagagaagaacgataccaagatgacataaaagcgcggcagatgatgcacgaagcattgcaactccgcctaaatttggtaggaggaatgtttgacacggtgcagaggagcacccagtggactacagactgggccctgctactccttcagatcattacttcaggaactgttgacatgcacactaacaatgaattattcacaacagttcttgacatgctgggtgttttaatcaatggaacgttagcctctgacctatcaaatgcatcccctgggggatctgaagagaacaagcgtgcatacatgaatttagtaaagaaactgaaaaaagagctaggagacaagcgatcagaaagtattgacaaagttcgacagttactacctttgccgaaacagacatgtgatgtcatcacttgtgaacctatgggttccttgattgacacaaaaggaaacaaaattgctggatttgactctatagataaaaaacagggtctccaggtctctacgaagcagaaggtgtccccgtgggacttgtttgagggtcagaagaacccagctcctttgtcctgggcctggtttgggacagtccgagtggaccgaagagtgatcaagtacgaggagcagcatcacctcctgctgtatcacacacaccccatgcccaagccccgcagttactacctccagccactgcccctgcctcctgaggaggaagaggaagagcccacatctccagtttctcaggaaccagaaaggaagtccgctgagctgtcagatcagggaaaaaccacaacagatgaagaaaagaaaacaaaaggaaggaagcgcaagacgaaatctagctcaagagttgatgaatatccacagagcaacatataccgagtgcctcctaattactcgcctatctcctcccaaatgatgcaccatccacagtccaccttgtggggttacaacctcgtgggccagccccagcagcccggctttttccttcagaaccaatctcttactccaggtggctccagattggaccctgcaggctcctttgtcccaaccaacaccaaacaagctctgtcaaacatgctacagcggcgctcaggcgccatgatgcagccgccttctcttcatgcaatcacatcgcagcagcagttgatacagatgaagcttctgcagcagcagcagcaacagcgacttctcaggcaagcccagactcggcctttccaacagtttcccaggcaaggcttgcagcagacccagcagcagcagcagacggccgccttggtgcggcagctccagaagcagctttccagcaaccagccacagcaaggagtgactccgtatgggcatccttcacacttctgaatctgcaagaggagaagacatgacgttttatgtttgcactgaaaaacagaaaatcaaatttaatgcattagtcatcttaaaaatgtccctttttttcatttctttgacattttactatattttatgctacatctcacaaaaaaaaaaaaaggtgtttaaacaaaaagccaaggagaagttgtggtttgattttgttgaattcacctttaaagtaggtttacaaatgtgaatcatgcaggcaggcctactcccggaagagtgtgctagcagaccttttgaaattggtgctttttttgaatctcacatttctagaaagaatggattatgatggatctaaggtatttatgtatttcattcattaatgatgacgttgtttttttttttttaattttattttccaaactgtgctggaccaaactactgatttgaaaggcatgtcagatcttgacagaaacatggcctgtttattctgcattcacctgtgatggtgaaacggacatttatttgcatcgctctaatttgaaatgtttgtaatctcataagcactttataaactttgttcttatttatgtaggactcttctttgcttttgttgtggtcaaaaggtgctgaaacagattgttgcttcgtacttaaacttcttaaaccaagaacctaaaccaaggtttctttgagagccgccctaagatgtgcggaaacctgttagaagtagctgtactcaaatttgttttgaggcaagatcattgatgagagtcattgtgaaggtacaacatgtaaatcctaaaggcctgaaagaactgcagtggaatcgtccaactatttattgccagttttggttctcctgaaccttatgccaccttaaggggaaaaaaaaatccagtagctggcttgagattccagtgctcacacttgacatggtttccagagaatctggcccc

SEQ ID NO: 152137 - DNA, 2862 bp, Homo sapiens
  Payload ID: 9940
  Gene Symbol: MED12L
  Gene Name: mediator complex subunit 12-like
  Uniprot ID: Q86YW9
  ENST ID: ENST00000309237
  CDS Start-End: 534-2804
gtccgctccacagcttcttcccgggaggggagggccaccctcgccttgggcgagcacttcagccaccagcctaggcgccaagaaaagtttttttttttttttttccagtgccccacccccacccccatcctgcgcccagctggggtgggtttgggtccattggtgaaaaaagtcacacgttcccatcagctgctcctccccctggagacaaggtaggggggagcagaggaggcaggcgccgcggaggaccctggccgacctctagtccctccgccgccgccaccggagcggtgcgtcccggggctcgagcgcagccgagtacccgccgaaggctgtccccatcagtgcgtgtctgctgccgggcagcggcagcatccaacctgctttattcctcctgcctgcagcgccacagcgagcgagcgagcgaggagggggagagagggagtctgtctgcaaagtgctgctccctggtgctcagaggcggctgctccagctccaactctcattcatttcgccggttaacatgagagatcatggccgccttcgggcttctcagctatgagcagagaccgctgaagcgcccccggctcgggccgcccgacgtctacccacaggaccccaagcagaaggaggatgaacttactgctgtgaatgtaaagcaaggcttcaataatcagccagccttcactggagatgaacatggctcagccagaaatattgtaattaacccatcaaagattggagcttattttagcagcatattagctgagaaactgaagcttaacactttccaggacacgggaaagaagaaaccacaagttaatgctaaagataattattggctggttactgctcgatcccagagtgcaattcatagttggttttctgacttagcaggaaataagccactttctattttggcaaaaaaggttcctatccttagtaaaaaagaggatgtttttgcatatttagctaaatattctgtgccaatggttcgagcaacgtggctgatcaagatgacttgtgcctattattctgctatatctgaagctaaaattaagaaacgtcaggctcctgatccgaatttggagtggacacagatatctaccagatatcttcgagagcagttggccaagatttctgacttttaccacatggcctccagcacgggcgatggccctgtccctgtgccaccagaggtggagcaagccatgaagcaatgggaatacaacgaaaagctagcatttcacatgttccaggaaggaatgttagaaaaacacgaatatttgacatggatcctggatgttttagaaaagatcagaccaatggatgatgatcttcttaaactcttgctaccactaatgctgcagtattcagatgagtttgttcagtcggcctacctgtctcgtcgtcttgcctacttttgtgcccggcgtctttccttgctgctgagcgatagccccaacctccttgctgcccactcaccccacatgatgataggaccaaacaactcgagtatcggggcccccagccctggcccccccggccctggcatgagccccgtgcagctggccttctcagattttctttcctgtgcacagcatggtcccctggtttatggacttagttgtatgttgcagactgtcactctctgttgcccaagtgccttggtgtggaattattccacaaatgaaaataagagcgcaaacccaggctcacccctggatctgctgcaggtggccccgtccagcctccccatgccgggtgggaacacggctttcaatcagcaggttcgggcaaggatttatgaagtagaacaacagataaaacaaagaggccgtgcagtggaagttcggtggtcatttgacaagtgccaagaatccacagcaggggtgactattagtcgggttttgcacacgttggaagttttggatcgtcactgttttgaccgaactgattccagcaattccatggagacactttatcataagattttctgggcaaaccaaaacaaagataaccaagaggttgcgcccaacgatgaagctgtggtgacgctgttatgtgaatgggccgtgagctgcaaacggtctggcaagcacagggccatggctgtggcaaaactcctggagaagaggcaagcagaaattgaggcagagagatgtggtgaatcagaagtcttagatgagaaggagtctatttcttcatcctctcttgctggatccagtttgcctgttttccagaatgtgctgttaaggtttttagatacacaggccccctctttgtcggacccaaacagtgaatgtgaaaaggtggaatttgtgaacctggtgctgctcttctgcgagttcatccgccatgatgtcttctcccatgacgcatacatgtgtaccctcatatctcgaggagatttgtcagtcactgcctcaactcggccgcggtcaccagtaggggaaaatgcagatgaacactattcaaaggaccatgatgtgaaaatggaggaacagagtattatggcgcatatgggcattgactcaggaaccactaacatttttgatgaagtagacaagagtgactttaaaactgactttggttcggaatttccaattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggtaagtcattgcttcagttaatctataccctgattattttattataagatcaataactgttgaacgtcagattattcaa

SEQ ID NO: 152138 - DNA, 2757 bp, Homo sapiens
  Payload ID: 9940
  Gene Symbol: MED12L
  Gene Name: mediator complex subunit 12-like
  Uniprot ID: Q86YW9
  ENST ID: ENST00000422248
  CDS Start-End: 534-2699
gtccgctccacagcttcttcccgggaggggagggccaccctcgccttgggcgagcacttcagccaccagcctaggcgccaagaaaagtttttttttttttttttccagtgccccacccccacccccatcctgcgcccagctggggtgggtttgggtccattggtgaaaaaagtcacacgttcccatcagctgctcctccccctggagacaaggtaggggggagcagaggaggcaggcgccgcggaggaccctggccgacctctagtccctccgccgccgccaccggagcggtgcgtcccggggctcgagcgcagccgagtacccgccgaaggctgtccccatcagtgcgtgtctgctgccgggcagcggcagcatccaacctgctttattcctcctgcctgcagcgccacagcgagcgagcgagcgaggagggggagagagggagtctgtctgcaaagtgctgctccctggtgctcagaggcggctgctccagctccaactctcattcatttcgccggttaacatgagagatcatggccgccttcgggcttctcagctatgagcagagaccgctgaagcgcccccggctcgggccgcccgacgtctacccacaggaccccaagcagaaggaggatgaacttactgctgtgaatgtaaagcaaggcttcaataatcagccagccttcactggagatgaacatggctcagccagaaatattgtaattaacccatcaaagattggagcttattttagcagcatattagctgagaaactgaagcttaacactttccaggacacgggaaagaagaaaccacaagttaatgctaaagataattattggctggttactgctcgatcccagagtgcaattcatagttggttttctgacttagcaggaaataagccactttctattttggcaaaaaaggttcctatccttagtaaaaaagaggatgtttttgcatatttagctaaatattctgtgccaatggttcgagcaacgtggctgatcaagatgacttgtgcctattattctgctatatctgaagctaaaattaagaaacgtcaggctcctgatccgaatttggagtggacacagatatctaccagatatcttcgagagcagttggccaagatttctgacttttaccacatggcctccagcacgggcgatggccctgtccctgtgccaccagaggtggagcaagccatgaagcaatgggaatacaacgaaaagctagcatttcacatgttccaggaaggaatgttagaaaaacacgaatatttgacatggatcctggatgttttagaaaagatcagaccaatggatgatgatcttcttaaactcttgctaccactaatgctgcagtattcagatgagtttgttcagtcggcctacctgtctcgtcgtcttgcctacttttgtgcccggcgtctttccttgctgctgagcgatagccccaacctccttgctgcccactcaccccacatgatgataggaccaaacaactcgagtatcggggcccccagccctggcccccccggccctggcatgagccccgtgcagctggccttctcagattttctttcctgtgcacagcatggtcccctggtttatggacttagttgtatgttgcagactgtcactctctgttgcccaagtgccttggtgtggaattattccacaaatgaaaataagagcgcaaacccaggctcacccctggatctgctgcaggtggccccgtccagcctccccatgccgggtgggaacacggctttcaatcagcaggttcgggcaaggatttatgaagtagaacaacagataaaacaaagaggccgtgcagtggaagttcggtggtcatttgacaagtgccaagaatccacagcaggggtgactattagtcgggttttgcacacgttggaagttttggatcgtcactgttttgaccgaactgattccagcaattccatggagacactttatcataagattttctgggcaaaccaaaacaaagataaccaagaggttgcgcccaacgatgaagctgtggtgacgctgttatgtgaatgggccgtgagctgcaaacggtctggcaagcacagggccatggctgtggcaaaactcctggagaagaggcaagcagaaattgaggcagagagatgtggtgaatcagaagtcttagatgagaaggagtctatttcttcatcctctcttgctggatccagtttgcctgttttccagaatgtgctgttaaggtttttagatacacaggccccctctttgtcggacccaaacagtgaatgtgaaaaggtggaatttgtgaacctggtgctgctcttctgcgagttcatccgccatgatgtcttctcccatgacgcatacatgtgtaccctcatatctcgaggagatttgtcagtcactgcctcaactcggccgcggtcaccagtaggggaaaatgcagatgaacactattcaaaggaccatgatgtgaaaatggagattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggtaagtcattgcttcagttaatctataccctgattattttattataagatcaataactgttgaacgtcagattattcaa

SEQ ID NO: 152139 - DNA, 10744 bp, Homo sapiens
  Payload ID: 9940
  Gene Symbol: MED12L
  Gene Name: mediator complex subunit 12-like
  Uniprot ID: Q86YW9
  ENST ID: ENST00000474524
  CDS Start-End: 39-6476
ccaactctcattcatttcgccggttaacatgagagatcatggccgccttcgggcttctcagctatgagcagagaccgctgaagcgcccccggctcgggccgcccgacgtctacccacaggaccccaagcagaaggaggatgaacttactgctgtgaatgtaaagcaaggcttcaataatcagccagccttcactggagatgaacatggctcagccagaaatattgtaattaacccatcaaagattggagcttattttagcagcatattagctgagaaactgaagcttaacactttccaggacacgggaaagaagaaaccacaagttaatgctaaagataattattggctggttactgctcgatcccagagtgcaattcatagttggttttctgacttagcaggaaataagccactttctattttggcaaaaaaggttcctatccttagtaaaaaagaggatgtttttgcatatttagctaaatattctgtgccaatggttcgagcaacgtggctgatcaagatgacttgtgcctattattctgctatatctgaagctaaaattaagaaacgtcaggctcctgatccgaatttggagtggacacagatatctaccagatatcttcgagagcagttggccaagatttctgacttttaccacatggcctccagcacgggcgatggccctgtccctgtgccaccagaggtggagcaagccatgaagcaatgggaatacaacgaaaagctagcatttcacatgttccaggaaggaatgttagaaaaacacgaatatttgacatggatcctggatgttttagaaaagatcagaccaatggatgatgatcttcttaaactcttgctaccactaatgctgcagtattcagatgagtttgttcagtcggcctacctgtctcgtcgtcttgcctacttttgtgcccggcgtctttccttgctgctgagcgatagccccaacctccttgctgcccactcaccccacatgatgataggaccaaacaactcgagtatcggggcccccagccctggcccccccggccctggcatgagccccgtgcagctggccttctcagattttctttcctgtgcacagcatggtcccctggtttatggacttagttgtatgttgcagactgtcactctctgttgcccaagtgccttggtgtggaattattccacaaatgaaaataagagcgcaaacccaggctcacccctggatctgctgcaggtggccccgtccagcctccccatgccgggtgggaacacggctttcaatcagcaggttcgggcaaggatttatgaagtagaacaacagataaaacaaagaggccgtgcagtggaagttcggtggtcatttgacaagtgccaagaatccacagcaggggtgactattagtcgggttttgcacacgttggaagttttggatcgtcactgttttgaccgaactgattccagcaattccatggagacactttatcataagattttctgggcaaaccaaaacaaagataaccaagaggttgcgcccaacgatgaagctgtggtgacgctgttatgtgaatgggccgtgagctgcaaacggtctggcaagcacagggccatggctgtggcaaaactcctggagaagaggcaagcagaaattgaggcagagagatgtggtgaatcagaagtcttagatgagaaggagtctatttcttcatcctctcttgctggatccagtttgcctgttttccagaatgtgctgttaaggtttttagatacacaggccccctctttgtcggacccaaacagtgaatgtgaaaaggtggaatttgtgaacctggtgctgctcttctgcgagttcatccgccatgatgtcttctcccatgacgcatacatgtgtaccctcatatctcgaggagatttgtcagtcactgcctcaactcggccgcggtcaccagtaggggaaaatgcagatgaacactattcaaaggaccatgatgtgaaaatggagattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggatgaatcttcaagtcatgaatgtaaccagcgcacaatccttctctatggagtcggcaaagagcgtgatgaagcaaggcatcagctgaagaagattaccaaagatatcctgaaaattctaaataagaagagcaccacagagacaggggttggggacgaaggacaaaaagccaggaagaacaaacaggagacatttccaacactggagactgtgttcactaaactccagctcctttcatattttgatcaacatcaagtgacatctcagatttctaacaatgtgctagaacaaatcacaagctttgcgtcaggaacatcctatcatctccctttggctcaccacattcagctcatctttgatctcatggagccagcactgaacatcaacggactaattgacttcgcaatacagttactaaatgaactgagtgttgtggaagctgaactgctcctaaaatcctccagcctggcaggaagttatacaacaggactgtgtgtctgcatcgtggctgttctcaggcgctatcacagttgtctaatcttgaatcctgatcagacagcccaggtgtttgaagggttgtgtggtgtggtcaagcatgtcgtaaacccctcagaatgttcttcccctgaaagatgcattttagcctacctctatgatctctatgtgtcatgtagccacctcagaagtaaatttggagacctcttcagtagtgcctgttcaaaagtaaagcaaaccatatataataacgtgatgcctgcaaattcgaacttgcgatgggatccagacttcatgatggattttattgagaatccctcagcccgcagcatcaactactcaatgctgggcaagatcctcagtgacaatgcggccaatcgctacagctttgtctgcaatacactcatgaatgtatgtatgggccatcaggatgctggcaggattaacgacatagccaatttctcctctgagcttacggcttgctgcactgttcttagttcagaatggctgggggttctgaaggctctttgttgttcttcaaatcacgtgtgggggtttaatgatgtactttgcactgtagatgtgagtgacctttcattccatgattcattagctactttcattgctattctgatagcacgacagtgtttttccctggaggacgtcgtgcagcatgtcgcacttccctctcttctagcagcagcttgtggggatgcggacgccgagcctggggcgagaatgacatgccgactcttgcttcatctcttccgagctccccaggcctgcttcttacctcaagcaacgggcaaacctttccctggaataagatcatcttgtgatagacacctcttagccgctgctcacaacagcattgaagtgggagccgtgtttgctgtcttaaaagcaattatgatgcttggagatgccaaaattggcaataacagtgtcagctctttaaagaatgatgacttcaccatgagaggtttgcgatgtgatgggaatgctgatgatatctggactgcctcacaaaatccaaaatcctgtgggaaaagcatttccatagaaactgccaatttaagagaatacgctagatatgtactgaggactatctgtcaacaggaatgggtaggagagcattgcttaaaagaacctgaaagattatgtacagacaaagaacttatattggaccctgtgctttcaaatatgcaagcacagaaattactgcagcttatctgttatcctcatggcattaaagaatgtaccgagggggacaatctgcaaagacagcacattaagcgtattcttcagaatcttgagcagtggacactgaggcaatcctggttagaactccagctaatgatcaaacagtgcttgaaggaccctggctctggttctgtggccgaaatgaacaacttactggacaatattgcaaaggcaacaatagaggtattccagcagtctgcagacctaaataattcttctaattctggcatgagcctcttcaacccaaacagtattggaagtgctgatacaagtagcacgagacagaatggaataaagacattcctaagttcctccgaacgcaggggtgtatggttggtggcccccctcatcgccaggttgccaacttctgtgcaaggaagagtgctgaaagccgctggggaagagctggagaagggacagcacttgggttcttcttccaaaaaggaaagggacagacagaaacagaaaagtatgtctcttttgagtcaacaacccttcctctcactggtacttacctgccttaagggacaagatgaacaaagggaaggcctcctaacatctctccagaatcaagttaaccagattttaagtaactggagagaagaacgataccaagatgacataaaagcgcggcagatgatgcacgaagcattgcaactccgcctaaatttggtaggaggaatgtttgacacggtgcagaggagcacccagtggactacagactgggccctgctactccttcagatcattacttcaggaactgttgacatgcacactaacaatgaattattcacaacagttcttgacatgctgggtgttttaatcaatggaacgttagcctctgacctatcaaatgcatcccctgggggatctgaagagaacaagcgtgcatacatgaatttagtaaagaaactgaaaaaagagctaggagacaagcgatcagaaagtattgacaaagttcgacagttactacctttgccgaaacagacatgtgatgtcatcacttgtgaacctatgggttccttgattgacacaaaaggaaacaaaattgctggatttgactctatagataaaaaacagggtctccaggtctctacgaagcagaaggtgtccccgtgggacttgtttgagggtcagaagaacccagctcctttgtcctgggcctggtttgggacagtccgagtggaccgaagagtgatcaagtacgaggagcagcatcacctcctgctgtatcacacacaccccatgcccaagccccgcagttactacctccagccactgcccctgcctcctgaggaggaagaggaagagcccacatctccagtttctcaggaaccagaaaggaagtccgctgagctgtcagatcagggaaaaaccacaacagatgaagaaaagaaaacaaaaggaaggaagcgcaagacgaaatctagctcaagagttgatgaatatccacagagcaacatataccgagtgcctcctaattactcgcctatctcctcccaaatgatgcaccatccacagtccaccttgtggggttacaacctcgtgggccagccccagcagcccggctttttccttcagaaccaatctcttactccaggtggctccagattggaccctgcaggctcctttgtcccaaccaacaccaaacaagctctgtcaaacatgctacagcggcgctcaggcgccatgatgcagccgccttctcttcatgcaatcacatcgcagcagcagttgatacagatgaagcttctgcagcagcagcagcaacagcgacttctcaggcaagcccagactcggcctttccaacagggccagccgggggaccaggctgctctctttgctgcgcaagcacggccctcccctcagctccctcagtatccagggctgcagcaagcacagaccatgccacagggctatacaatgtatgggacacagatgcctttgcagcagacatcgcagcagcaggctggcagtgtggtcctgtctcccagctataactccagagcctatccggccgcacattccaaccccgtgctaatggaaagactcagacagattcagcagcagccgagtggctatgttcagcagcaggcctcgccgtacctgcagcccctgactggctctcagagactgaaccatcaggctctacagcagagccctctggtgggcgggggaattgatgctgtgctgacttctgcacatccaaaccttccctccgtgcccctgcctcaggatcccatgagacccagacagccgcaagttcgacagcagcagagactcctccagatgcagcagccccagcagccccagccccagcagcctccccagccccagcagtcctcgcagtcccagagtcagacccttggtctccaagcaatgcagccccagcagcccttgtttcccaggcaaggcttgcagcagacccagcagcagcagcagacggccgccttggtgcggcagctccagaagcagctttccagcaaccagccacagcaaggagtgactccgtatgggcatccttcacacttctgaatctgcaagaggagaagacatgacgttttatgtttgcactgaaaaacagaaaatcaaatttaatgcattagtcatcttaaaaatgtccctttttttcatttctttgacattttactatattttatgctacatctcacaaaaaaaaaaaaaggtgtttaaacaaaaagccaaggagaagttgtggtttgattttgttgaattcacctttaaagtaggtttacaaatgtgaatcatgcaggcaggcctactcccggaagagtgtgctagcagaccttttgaaattggtgctttttttgaatctcacatttctagaaagaatggattatgatggatctaaggtatttatgtatttcattcattaatgatgacgttgtttttttttttttaattttattttccaaactgtgctggaccaaactactgatttgaaaggcatgtcagatcttgacagaaacatggcctgtttattctgcattcacctgtgatggtgaaacggacatttatttgcatcgctctaatttgaaatgtttgtaatctcataagcactttataaactttgttcttatttatgtaggactcttctttgcttttgttgtggtcaaaaggtgctgaaacagattgttgcttcgtacttaaacttcttaaaccaagaacctaaaccaaggtttctttgagagccgccctaagatgtgcggaaacctgttagaagtagctgtactcaaatttgttttgaggcaagatcattgatgagagtcattgtgaaggtacaacatgtaaatcctaaaggcctgaaagaactgcagtggaatcgtccaactatttattgccagttttggttctcctgaaccttatgccaccttaaggggaaaaaaaaatccagtagctggcttgagattccagtgctcacacttgacatggtttccagagaatctggccccaaagtccagaaggctctggttttcataaaaggtgtatttgctgtttattttgtatggtaagtatttgctcttttgaatttaattattactgtcagtgtcagtcttggttgtgtattgcatatactgtatttataaattggtgcaaaaagcacaagtaaattatacatcaaatttattataaagaaatagtaactattttaactttgttcaagtatgtggtaatttgctcctattagagtaaaaaagaaaccagtaaattatcagtttgtgtaacttaagagtattctatataatatttttttagatttagatgcataaaattttgaatgtgaaaattgcagggcattttaaaacatatgtgggggatattttcccatgttctctgttatttcattttcttttgccatatgattttacatataatatagtcaagcatactgtgaatagacttgtctataatgagcagaccatgtaaatctactttttttaaaatgtagctagtacaactttagtagacattttcttttgcaaatcattatctataaataatttatatcttcctgggtgagttactcattgcaaagtttgactcatgcaaatgacctcaaatacatgtcagcttactttgctgtggcaacatccatgtgaactgctttgtacactgtgaaaatatttcactccagcctgcccattttgtgtttactctgggctggaaaagactttgccaaaacattaaaaactattcttttcactaaattaatagtctatctgctttcagaagatgtatcatctatctgtacacatttttgctggttttgtatatcagattttttcctctcaagaaacatacttagataagctaatgaagttgttttcttcaaagtaatatatctatataatgactgcattggcaaatcaaccgaaatgtgaatgttgtgcctagtgagtgagtcatgttccatcattatttctttccaaatttctttgccagttcagtttgaaccatatattttgtagctcagcattgcaaacaacagtaatactgttttaagaatgagtgttataattgcatagcatttgtatgcactttatactttgcagaggtgagttaaattattaatcattttgcacatgaaagctgtggggcatatcttttttctttttttaggtgaggaagttatgctacgactctaattaattccacgattctattgaaagttgaggaatgctgttttacccctgcgcattataaagaaaataactagaattactttagtcttcagattttctccctgttaattctgtatcttgagaggtttcttttttttttttttttttttcttttcttgcaaatgcattcttttgcattaagatggtcacaaggtaaagccctgtggcagaacctggtactttaccttaccagaggaaattaccttagaataagatggagcgagaccccagctccccttaaagacaagaccttgaaatcaaatggagtcagctatacctatcaatcaatcacagttcttggatataagaagcccatagactctcttgtttacactgtaggctttttcttaatagggttgcatttgtcagtcattgcatttacccttcttggcctggaagtagaggagatcaatgcgtagctttgaccacttccagccacagggtactaacatcagacataagttgcaaccaggtcacattttaggctgagatggggctaactgaaagtcagtgtgatgaaaacccaagggcgctattccacatgtctcaaatgattggcaggggctaacttattagtaattctcggttttgtgcactgagatatctaagacctatggcatttttttcccatttataaagctcctataattcttaagtaagtactaggtgaatgtttgaatagatgctggagaaattacactggaaaaccccacccctagatttagataagatcaatcatttaatattccccaaattaattcaggttgaattaagcatgtaatataaattcagtgaattacaaaaacacattttgtgtaggattgatcagattttaaatacagtgaaacttcattatatataatagacctagaccctcccaagcattttcccatcccataaagaattaatgaaatgaaatgcttatagagcaacgattcctgctcagaaaaatttccttataaacagctccaaaccaggggtgcctgagctagattttaaagttataaagaagtttcattgtatttttaaaacctttttaatgggtgtatttggacaaaaataacccccttttcacattttatgatgtgcaggtattacattgctttttacatgtggaaaagtgagcctgcatttatttttaaatgcagttattaaaacatttttgtattccccatcaatgaaaattttcagtgtgaacaaatggtgaatcataagacagttcagtgcttattttctgtaggttttagcaaaaaaatttataaaccacaaaatatttatacatcaggatggtaaatttacatcataaagattgcagatttaatattttccattgtctctgttctgagtgccatgcttgtaacattgataggaggtggacactaggcaactggtattagaagttcatttttttactgaaaaattcaggtacattagccatttgttattttatagtgaaccgtttcaatgtttgtttattgttatttgttggcaaaataaaagtgccttaagttaaaagtttgttttgagatccattaaataaatcagtatcatcagttcataatgcatttatttacaagtccttttattttgcatgttcattgtaaatttaatactgtaaatgtattcaaattcatttacatgcctatggctgcctttgattaaacttcttccaaaaaataaattctgcccagatgttgttgactttattatttcatgtcagattacttgaatatacgttgctgcataatcactaccaagtgggttctttgctgtgcatttgtatatcccagaatcggaggtttggggattctgaatgactagggtaccttgtaagtgaagctgctcacttccatgtgtcctctctttacttgccgttgagagaagggagtggtcaggcatctcccatgtgatttctggcttgggaactcccaaggccacacagtggagctgaaaggctgcccctgtcctggtgacaatactcctgggtggacgatttgtaattcggggagggtaggctacaatcattactggaacagtaatcagtgtatgaccaacactattttgagccttacagatatagtttcctctgtcataagctgt

SEQ ID NO: 152140 - DNA, 749 bp, Homo sapiens
  Payload ID: 9940
  Gene Symbol: MED12L
  Gene Name: mediator complex subunit 12-like
  ENST ID: ENST00000480026
  CDS Start-End: 1-223
tgatgtgaaaatggagattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggtattgatgtctgttcctccttctgtttgagagtcacctctgaggatcataaaaaattgagataagtgatgtaaacttccacatgtgttatatgttttgtttatgttaaaatagcgaatatgccttgtgtagaattagactgcatgttataagtctgacctgttttatcatttacatttgaacttattgaaatgagaagtcatcttcagaagagactttgcacaataacatgtaataaaggtgttggcattaattcttaaatggatttgatgtagttgtatatggtatggtgagtcatggtatctaatatctttgaacaaagaatttacaacaaagaatgatttagagtttaatgtaaattttgtattttatacacaccaatacaaacaagtaattacaaacagatcaatcactttcctctcagtagttatgctgtgcaactttgtaatcatatttaattaatttttttcactaaggtaaaatgttcattaacctaattagcagctattttctagaagctaattaataaaggtaagtgtcaatgatggtattattg

SEQ ID NO: 152141 - DNA, 10465 bp, Homo sapiens
  Payload ID: 9941
  Gene Symbol: MED13
  Gene Name: mediator complex subunit 13
  Uniprot ID: Q9UHV7
  ENST ID: ENST00000397786
  CDS Start-End: 78-6602
gtttctctctctggtcggaggcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtagaagatgggacatctagtgtaacagtgttatcacatgaagaagatgctatgtcattatttagtccctctatcaagcaagatgctccacgccctactagtcatgcccgtcctccatcaacaagtttgatttatgactcagacctggctgtctcttatactgaccttgataatctcttcaattctgatgaagatgaactaacacctggatctaaaaaatcagcaaatggatcagatgataaagccagctgcaaggaatcaaagacaggaaatctggacccgttatcttgcataagcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagatttttcttatgtctataagcctgaaaattgtcaaattctagtgggatgttccatgtttgcacctctaaaaactctaccaagccaatatctgccccctatcaaattgccagaagagtgtatttaccgtcagagttggactgttggaaaattggaattgctttcttcagggccttcaatgccattcatcaaagagggtgatggaagtaatatggatcaagaatatggcactgcttatacacctcaaactcatacttcttttgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactttgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgagtcctgtcgattaggtcaacatagacctgtttctcgactgttaacagatgggatcatgagagttggatctactgcatcaaagaaactatcagaaaagttggtagcagaatggttttctcaggcagctgacggtaacaatgaagcattttctaaactcaagctttatgcacaagtctgcagatatgacctaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatgatggagcagatggaatgggtatctttgatttgttagacacaggagatgatcttgaccctgatatcattaatatccttcctgcttctccaactggttctcctgtacattctccaggatctcattacccccatggaggtgatgcgggcaagggtcagagtactgatcggctactatcaacagaacctcatgaggaagtacctaatattcttcagcaaccattggcccttggttactttgtatcaactgccaaagcaggtccattacctgactggttctggtcagcatgtcctcaagcacaatatcagtgtcccctttttcttaaggcctctttgcacctccacgtgccttcagtgcaatctgacgagctgcttcacagtaaacactcccacccacttgactcaaatcagacttcagatgtcctcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaagaagggacttgaattttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatctttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaatttctgtacaccttattgtttggccagaaggccaccaagtgtacttatatgtaatccttaaattttaaagtagctgtaatttttaaatatttctaaacttttcttaaaccactaaaattaagctcttactacttagtcaactatcctcagctgtattcgtactcaattgtcagtatggcacagattactgtattaaaatattctcctttcgtcttcatatttaccttctgaggtaattttttaacttaatgtgttactacaaagatttgcagatctttaatcaagcactatgttaatactgtaatatcagaatactatgttgcattatttaaaatgttcaaattgaatagattaaaaagtttttaaatgctattgcatcatataatttgctattcatccactatggcattgcatatcaatcagttaatacacttaatgttgcatgagtgatattttggtctgggtttcctcttaagattttagtttgtctgaattaaggaaaaatgtttttaatatacattcttattttgtcccacccctccagaaataagctggaaatcttaactttttggggggtcttttttggtgttttaatgggcccagaactgtggtttaaatttttatgtatgtattttcttttttgtggagtataaatttaaaaactggatttgggacctaaaatactcctcaggttgatgtattcatgaagttttaaaacatctttagttttcaaagtaaactggatatgtggaccttaaagttattgagtttaagctacaaattgtaacgtcattactggacatgtcagcatcaaccctctcaaaatagcttggtcactttatgaaggggcgttttaaagttgttgtttagcagtgacatttaatatggtccaattgcttttctttttaacgtgacaaaaagagaataaggaacaaacactattgctgccgaatgccataacactgagttgtacaaattgtgattgaggaaatgaaaaggtttatactttttaaaaaaaaaaaaacaaaaacaaaaaacaaaacttcaaatggaataaattattcatgaagccttca

SEQ ID NO: 152142 - DNA, 1068 bp, Homo sapiens
  Payload ID: 9941
  Gene Symbol: MED13
  Gene Name: mediator complex subunit 13
  ENST ID: ENST00000583958
  CDS Start-End: 1-982
tgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagtatgtattttttttaatagtcaccattataatttaagggtggaagtgatgcaagttcttaatactaggactcagtattggattcaaggtaggatttacaagaataaattcattgagtattaa

SEQ ID NO: 152143 - DNA, 14234 bp, Homo sapiens
  Payload ID: 9942
  Gene Symbol: MED13L
  Gene Name: mediator complex subunit 13-like
  Uniprot ID: Q71F56
  ENST ID: ENST00000281928
  CDS Start-End: 208-6840
cccccccgccagcccgggcccgctgcccccggcgcggcgtcgccgcggcgcctcccgcctgcccgccggccctcgcgccctcccccggcggcggcggcggcccggccgccccgcgctccccggcgaggcgccgccgcccggcccggcctcgcctcggacgcctcgctccgacatgccccgctctggcggccgggctcgcggaggatcatgactgcggcagcgaactgggtggcgaacggggcgagcctggaggattgtcactccaacctcttttcgctggctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatgtgctggacatcagcatgctctcctcccaggatgtggttcgtatgctgttgtccctgcagccctttctccaagatgccatccaaaagaagcgcacgggcaggacctgggagaacatccagcatgtgcagggaccactcacttggcagcagttccataaaatggcaggacggggaacctacggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgagatgtgtaggcttgggcagcacaagcccatctgcaaagtgctacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatgcttcttgtacacacatcttggtgttcccaacatcatcaaccatccaggtggctccagccaactaccccaatgaagatgggtttagccccaacaatgatgatatgtttgttgaccttccattcccagatgatatggacaatgatattggcatattaatgactgggaacctccattcctctcccaactcttccccagtaccctccccaggctctccttctggaattggtgtgggctctcacttccagcatagtcggagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggcttcgctgcatcaccacatttcagtagcacagacagacgaacttctgcctgccaggaattctcagcgggttccacaccctcttgactccaaaaccacgtcggatgttttaaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacactaaaagactttgataaaaagaaacaataataaaaggcctccattttaaatgtcattcatatataccttgtggatgagagctatatacttttacacacttttttagaggaataaattattgaattactgaagctttgagtggcttttttcccttcctctcctgcctttgtataaaattatctacacctgtttgagaggtgcatgtatatgtattgaatagccctagattagtagccaggcctctaccttccagtcagtgcaatggatgtagaattttaccaccctgatcacccccctaacagctgttctgaaatggtattctcatgctccagggcacaagtacactcccccatcagtttttacatgctaacacacacaacaccgaatcaactgctgtgagtcgatgagctctaatggtgtctctcagctgtaagattgtggtcaattctagcacaaatgacaagtctgtatcttatattccaccgcctttctctacacagtctcagccagtttctttatgatgtctcttagaaatgacagatacatctctctctgctgttttcctgattcacaggctggtgacgggagtttggcatctgatacaccacacgcaagtccctgttggctgcacaccatctaccatgctgttcccttcttgggtccatcagctaggaaaagccacatgttctagcaggagttgcgagggtatatttcgtatactgcccttgcaaaatctctcattaaaaatggttaaaccccaggacttggcagagcttacaataaacatttgaataattggaaaggccttgcttttaatctgccttcatcattttagaaatatacgttgttctgaacctaacattatcagaatccagagataaagctattgagacaactcaaccttctgttacttcatctgcaaatgagggatgaggatgattgcatgagaaatgctttgcaaactaaaaggcttgtatccatgttacagctgcactgttgaagaaagactgagaaaagtgaggccaactttttggttaaaaaataatagtgatctcatccagttactgccttacatatataacttttatatagtcctgcagcagctaaataatcagaactaggaggtacttttacaagcattcagtagcttcaatgcttagctcatacgttgggtggtactatattcaacaattagtgttggctttatagtaggaatgtcattttcataagtgcccccacctgtaccaattcagcaaccgcagctaaatctctttgaggtaggataaatgaatgcatttaaatgtcttccaagttagatgtagataagccatcagccttcagcagtttgcatcacccagattctgctcttcacaccagttcattccctccaaccatgtgattatgtagtttttggttttactgttcaggaagtcatgagcaaaggtatttgttaccaactgggcatcaaagaaccactaaaaatctttataaaagtacagttcgtcaatgagtttttaaaagcaaacctcgtaagacatactgcagaagcataagccacatattgaaaacagtctttgccgcttgtcatttacagtcaagccagtataaaaaggaaatcgtgctttggaattcaccgcacgcccaaatcctatcaagatgcaattttcacttattaccgtgttattttggtgttaaacgattctcttgtttatattcccttgacaaaaaggtcactttagcagtaattatttcatgtcattaatacctaatgagacaccactagaaaattctgttgtgccaggtaattatagagggttgtaatgtttgccctgggcatcctgctctgcctggaaccagatttaccagtcttcctccactttgcttacaattccagggtcacgtttaaaaaagattttttgacacttaactgcttctagctagaacgctaaatcatgaagcagttaagaaatagaagttgatgagaaagtttaatctccaggaagaaggttggacataaccaaagtattgatttttctctgtaaaggctatttcctcaatgaattcaagttcccaggtgatgggaagacccgaagacagacattcctgttagtcccactttttctttgttttctttcaaacaagcagggaagtgaggaaagcacaggttcagttttaataatctgctaacatggcacttgtctgggctgttacccatatgggtcaaaccatgtctgtcctggagtgtgcttgaaattcacccagtgatcacagcatgcagacacgttgaaattggcagcatctctgagcatttctctggctcctgctgcctagtgtatacctcttttgccttgctgttgggtgaggcatgtttcaatctacttgttttataagactagacaatattcagtaaaatgggccaccccagagcttagaacagaagctctgggaaaaaaaatatctaatacgaggaagtattcgttgtgggggaatgtcaatttaaataatttaacatgtaaaatagtaattgtcttaatttaggctataacgtttttcagtaagcattttcacgttagcttctcataaatcttagtttgttcacttagaggtcttgatgttcttattaatttcgatacattatttacatatataatttcctgtctgcttcctttgaagtatgtgattttttttttaattgtagaggagacacagtttctgtaattatacatacaccagtgttttttgttgttgctatttcttgtattactgcaaagcttaggaggttttctctcttaggtctaggggtcaagatcacgtttgcttgataagatgaaccaatgaacttccccgtcattttccgtgagcccaaagagtttatctttcatgacaccaactttctattgggctgagactgaataaaggactgaagtaggcactcacgaaatgtttgtcaaatactgatactgttgaaagagtagaattagttgcacctcaaaaatctgaaataatttaccagtaaattcatcagatcctgatgccttttggggaagcggtttacaaaacaggaatttttttttttttcgtttttggttgatttggggtttccatttcttttgttgattttgttaatttagatttttacaggaaaaaaatgagtttttcaaatgtattacttaatgcaatggtgcagaatacccccttaattttgaaactttttggtgatgtatgctcttttccatttctagcaatattaatgcttttattccacctcgattgatttttctagcagtttgattttttttttttagtttttgtttgatttttccaaagaaacagctcatggacttaacaattctgctgtttgtaccttggctttgtcttcttattctttttcctagtttccttgagagttatgtttcattttgcttgaattttaattgcctgcttagttaatttattttcacttttgatgatataggcattatagcctgggggcttctggatgtgttggccctcctcaaattatatgcagaattcttcatgtgcatttttttttagggagacagtctttgtatcagattctcagagatgtcaaaccctaaaagggataaaattgcttttatcgtttgagatgtcaaacgctaaaagggatgaaatctggcactagatttaagttgattacatcctacaagtcttgatgcttaatgttttcatttttatttttatactcttggttctttatttcttttttgatccgtttttgttaaggaaaattctcttaaagtctctcacgctgtaatattctcctatgctacaacataatcttgcattctctgaaatcttcaaaacaaggtgtgtcctatttcatgggcagtgttgcctaatataaatagaatgtgaaccatacatgtaatttaatattttctagaagccacatttaaaaagtaaaaataaacaggtgaaattaattttaatatattttatttaaccaaatatatccaaattcttattccatgtcaacctaaaatcaatatgaaaattatcagtgaactatgtagcattcttatttttgcagtaagtctttgaaatctgtatgtagttaacatttacagcacgtctacatttggatgctaaattttcaatagttgaggaaaaatgtagttctatcaaaaaaaaagggatttagcagaaaaaatgcactgcttccgtttttaaattaaatttaaattaattagacttaataaaattaaaagattagtttctcagtcacactcaccgtatttcaaaatgatcaacagccacatggagtagtggtgatcctatgggccagtacagctggggtgtaagatttggtagcaactaattgtgtcttgagtatattgtttttgtttgttttctacaccccattcggacctcaacctctgtcccaggcaggcagtaggagttaaaatttcctgctggaagtttggtcttcctttgtacttccttactggtgcataaaggtttaatgatgtttatgtattatataatttatctctgtataatcaccctttgttctgcataatgctctttgctttaaattatccttttaataccgcccctctttcctttgattagaattccagtgttatatctttggcccaccacttattttcaacctttgtcattttgtgtcaggtgtacttcatacaaactcttgtattttatttcttaagagaacaatactatttttatttgaatagggtaatttttgcctttgcatttcctgtttcatgttatactttgacttgtcagccaatttttataaatacacatacagatttatttgcttcctttaa

SEQ ID NO: 152144 - DNA, 1041 bp, Homo sapiens
  Payload ID: 9942
  Gene Symbol: MED13L
  Gene Name: mediator complex subunit 13-like
  ENST ID: ENST00000549786
  CDS Start-End: 1-572
ggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccaggttactgtttgcaagtttattatttacttttgatgttgttatttttgttgttatgaaaataaatacaggcctatgatttttcttaaaaaatggaagtacaggttaattatcccctaaccaaaatactaggaaccagagtgttttggatttccgattttggaatatttgcatatatataatgggagacctttgcagtgggcccaagtctaaacataaaatttatttatgtttcatatacaccttacacacataacctgaaggtaattttatacaatatttttggtcatgttgtgctttatacaaagttttgattaaattttgactgcaatacatcacatgaggtctgataacggaattttccacttgtggcgttttattggcattccaaaagttttgggttttggtgcattttggatttcagattttttgattagggatattcaacctgtacatgaaagtataaaagaaaaatagtcataattccgtcttttacattcaacca

SEQ ID NO: 152145 - DNA, 568 bp, Homo sapiens
  Payload ID: 9942
  Gene Symbol: MED13L
  Gene Name: mediator complex subunit 13-like
  ENST ID: ENST00000548743
  CDS Start-End: 289-568
tgcaatcgcactccccttctcctcccctttcccccctttttttccccccgtaaatgtggaaggctttgccttgtgctgccgcgcctccgatcggcaacctcttcccccgttgttggatcagctgcctgcccgcccgcctgccttttgaatttttttaaattccataatgacacctgcaatttcgccctaaaatagttgattgaatgcgattgtgtcaggaaaggactcttgcacccgaagctcccgcgattgtaaacatcgacagccgcctgcctctcggggcttactatgctggagagccgtaaagccattgcaccgagccgacggaaggctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcagg

SEQ ID NO: 152146 - DNA, 665 bp, Homo sapiens
  Payload ID: 9942
  Gene Symbol: MED13L
  Gene Name: mediator complex subunit 13-like
  ENST ID: ENST00000552340
  CDS Start-End: 1-423
gagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgaggtaggtattggcaggacagaaacttagaaaatttatactaaaatgcaagctagaagaggtattttatctaacccagagattggctggttgcttagttggtcttctacattgatataagagttgctaggctggatgtgttggctcacacctgtagtcttagcactttcggaggctgaggtggaaggattgcttaagcctaggagtttgagaccacactgggcaacatagcaagaccccatctctacaaattttcttttaaaaattatcca

SEQ ID NO: 152147 - DNA, 584 bp, Homo sapiens
  Payload ID: 9942
  Gene Symbol: MED13L
  Gene Name: mediator complex subunit 13-like
  ENST ID: ENST00000552447
  CDS Start-End: 1-584
gcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacagggaccccttccccttccccatttctttatttgttaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatg

SEQ ID NO: 152148 - DNA, 7984 bp, Homo sapiens
  Payload ID: 9943
  Gene Symbol: MED14
  Gene Name: mediator complex subunit 14
  Uniprot ID: O60244
  ENST ID: ENST00000324817
  CDS Start-End: 120-4484
cggcccggcggtaggcggtggcgactctgcccgctcccgtttcggcgcggtgaccgagcgcccgggaggctcgaggaccgcatcgtgtgccgttgcgccaagcccggtcctgcgccgccatggccccagtgcagctggagaaccaccagctggtcccgcccggaggcggcggcgggggcagcggcggacccccgtcagccccagcccctcctcccccgggagccgccgtggcggcggccgctgcagctgcggctagcccgggctaccggctgagcaccctcattgaatttctgctgcaccgggcctactcggagcttatggtgttgacggacctactgccaaggaaatctgatgtggaaaggaaaatagaaatagtgcagtttgctagccggacacgccaactcttcgttcgattattagctttagtgaaatgggctaataatgctggcaaagtggaaaaatgtgcgatgatttcaagctttttagatcagcaagccatcctgtttgtggacactgctgatcgcctggcctcgttagctagagatgctctggtccatgcacgcctgcctagttttgccatcccatatgccattgatgtactaactactggatcttacccacggctgccaacctgcattagggacaaaattattcctccagacccaattaccaaaattgaaaaacaagccacactccatcagctgaatcagattcttagacatcggcttgtaaccacagatcttcctcctcagttagcaaatcttacagttgcaaatggccgggtgaagtttcgtgttgaaggagaatttgaagccaccttgactgtgatgggagatgaccctgatgttccatggcgtcttctcaagctagaaattctagttgaggataaggaaacaggagatgggcgagctttggttcatagcatgcaaatcagcttcatccatcaactggtgcagtctaggctctttgctgatgagaaacctcttcaggatatgtacaactgcctacattctttctgtttatcacttcagttagaagtgttacattcccaaactctaatgttaatccgagaacggtggggagaccttgtgcaggtggaaaggtatcatgctggaaagtgcctctccctttcagtttggaatcaacaggttcttgggagaaaaactggaacagcatctgttcacaaagttacaattaaaattgatgagaatgatgtctccaagcctttacagatttttcacgatcctcctttgccagcttctgattccaaattagtagaaagagccatgaagatcgaccacttatcaatagaaaaactcctgattgacagtgtccatgcaagagctcatcagaagctccaagaactgaaggccattcttagaggcttcaatgccaatgaaaactcttccatagagactgcactcccagctcttgttgttcccatcttggagccctgtggtaattcagagtgtctgcacatttttgtagatttacattctggaatgtttcaattgatgctttatggacttgaccaggccactctggatgacatggagaagtctgtgaatgatgatatgaaacgaatcataccctggattcagcaacttaagttttggcttggacaacagcgttgcaagcagtctataaaacatctgcctacgataagcagtgaaacattgcagctttccaattactcaactcatcctattggaaacctttctaagaataaactgttcattaaacttacccgccttccacaatactacattgttgtggagatgttggaggttcccaataaacccacacaactgtcgtacaagtactactttatgtctgtgaatgctgcagatcgtgaagacagccctgcaatggcattgctgctgcagcagttcaaggaaaacattcaggacttggtttttcgtacaaaaaccgggaaacagaccagaaccaatgccaagcgcaagttgtctgatgatccatgtccagtagaatccaagaaaacaaaacgagcaggagaaatgtgtgccttcaataaagttttagcccacttcgtcgctatgtgtgatacaaatatgccatttgtaggacttcggttggagttgtccaatctggagattccacatcaaggagtgcaagtggaaggtgatggcttcagccatgcaattcgcttattaaaaattcctccctgtaagggtataactgaggaaacccaaaaggctctggaccgctctcttcttgattgcactttccgattacaaggtagaaataaccgcacttgggtagcagagttagtgtttgcaaattgtccacttaatggcacttctactagggagcaaggaccatcccggcacgtttacctgacatatgaaaatctgttgtctgagcctgttggtggtagaaaggtggttgaaatgtttcttaatgactggaatagcattgcacgattatatgagtgtgtgttggaatttgcacgttctctaccagacatacctgctcatctaaatattttctcagaagttcgtgtttataattaccgaaaacttatcttgtgttatggaaccaccaagggaagctcaattagtatccaatggaattcgatccatcaaaaattccacatttctttgggaactgttggcccaaactcaggttgcagtaactgtcacaataccattctccatcagcttcaagaaatgttcaacaaaacaccaaatgtggttcagttattacaggtactgtttgatactcaggctccattaaatgccatcaacaaactccccactgtgccgatgttgggcttgacccagagaaccaatactgcctaccagtgcttctccattctgccacagtcgtccacccacatcagactggccttcaggaacatgtattgcattgatatatactgccggagtcgaggtgttgtggcaatacgggatggtgcctatagtctttttgataacagcaaactagttgaaggtttctatcctgcaccaggactaaagacgttcctgaatatgtttgttgacagcaatcaggatgctcgaagaaggtctgtaaatgaggacgataatcccccttctcctataggaggagatatgatggattctttaatatcgcagctccagccaccaccccagcaacagccatttccaaagcagccaggaacatcaggtgcttatcctcttacttcaccccctacatcttatcatagcacagtcaatcagtctccctcaatgatgcacacacagtctccaggaaatctgcatgctgccagctcccccagtggggctttgagagccccatcaccagcgtcatttgttccaactcctcccccatcctcgcatggaatctcaataggaccaggggccagttttgctagtccacatggaactcttgaccctagttccccatacactatggtgtcaccaagtggacgagcagggaactggccaggatctcctcaagtgtctggcccctcaccagcagcacgcatgcctggaatgtcaccagccaacccctcactacattctccggttccagatgcttctcattcccctcgagctggaacaagttctcaaacaatgccaacaaacatgcctccacctcgtaaactacctcagcgctcttgggcggcatccatacctaccatcctcactcacagtgccttgaacattttactgctgccctctccaactccaggccttgtgcccggcctggcaggtagttacctttgttctccacttgagagattccttggatcagtcatcatgagacgacatcttcaaagaattattcaacaagaaacgctgcagctgataaattctaatgaacccggagtgatcatgtttaagactgatgcactgaaatgcagagtagctcttagtcccaaaaccaaccaaacgcttcagctaaaagtgacacctgaaaatgcaggacagtggaaacctgatgaacttcaagttttggagaaattctttgaaacaagagttgcaggaccaccatttaaagctaatacgttaatagccttcaccaagctattaggagctcctacacacatcctcagggattgtgtgcacattatgaagctggagctgttccctgaccaagcaacacagctaaaatggaatgttcagttttgcctgacgatccctcccagcgcgccgccgattgcacctcctgggacgcctgctgtggtgctgaaatccaaaatgctattttttcttcaactaactcagaaaacatcggtccctccccaagaacctgttagtattatagttccaatcatttatgacatggcttcaggtacaacccagcaggcagacattcccagacagcagaactcttctgttgctgctcccatgatggtcagcaacattctgaagaggtttgcagagatgaatccaccacgacaaggtgaatgcacaatatttgcagctgttcgtgatttaatggctaatcttacactgccccctggtgggcgtccatagacactattgtttttaaaccaggaaggctgacagatgagacaacaaaaaaaatctgaattcagccttcagtttaaaaaaggaaaaggactttttttttaaactttaagagctaaatattctaaactggcaaaaattttcagggtgcacttctttcatcaaaatgatcatccatcttttgtataatgaacttgtatagtgtgtttaaatgggacacatttcaaaggaaataaatcagtgtccgtttgccagtaataaatttaatattctgttttatactataaagttatgaaaatgccaaacttgtttatttaattgttttcttatgttttgggtgtaatagtccttttttggtttttgttttgttttttaaggcaggtctgtcatttttgaatactgtaaaactgtgataaactttatattgaagctgtattttaatatgaccgctttgaatccttacatgaaatgttctgggagttgttataaacacaccccaaggaagcaatatttaataaaactaggtcaaaaacaaaacaaaacagtgacactcacttgtgtgtatataaactctagagacatcttaggccctcccttcatctttaacctggtggatggagccagttattaatttataataatacatgtctgaaatttgaccaaaaacatcttctttatgtcaaggttaatatattttcttcagacattcctaacttgactagtggttaacatttagcaccttggttgtctttcaatatataggatttgggtgaaaaataaggaacttagtctttgagaagggacagtatgtggttcgtattgatcaaggatcccaaataatgcaatcattctcatctgttgaggatgtgggaacttttctgtcaggaaaatttagtttacagaatacttctgcatacaacattaattaggaaacaaagaactttaatgctgtacctctgcatgaagtttctgtgagctttctttatcttgcttaacttatcctcctttccttccccaccaaaattgggattgttctaaacaatttcaatttaattcattgtcaacaaaacgatagaatgttttgcttggaagaaacctggtccattcccctcattgtgaagaatcccgaatcctgggcctgtccagggtcaaatggagtttttggtattaatacatctctgcagggtttctttttggagcactgtgctgtctttcctagtcagtcagggacttttttaagcttcaaagaacatggtctgatgcaaaggtcttctaccgacttcatggtatttaggaaaaatttttaagtgataataccatgccgagttacctggtcactgtaatactggttctccattaaaatgtagatgctttgtctaattccacttcaagatgatttaattgagcttctataactatcaactatcaaattctagtttcaagtatctcactgtacctatatcatatctgttctcaactttgtttgattctccactcattttcaatcagagttgaagccttctttgcctttcttctttgtcttatttctgccttcatctcccacttctcacccaactctgccactgttcaggagcagttgactaaacttttatccttcctttaacttaatctttttatccttctgtttttagttcttacagtggtaatcacatcagtttggcaatctaagatgtctttatcaagggtcagcccttttctatttggagctgaatcttttctttcatgtagaaatctacatgtatatacaagaaatgtatttttatctgcaggataatattgtttcaaataattttattaagagttaactttttaggtattttcccttttaatgtggttttgaaatgttaattgcatttttacacatgatgcattcagtggacactcttttttcctaattataactcatctctgaatgcattgtgccaatcaagagtaagataggattcagtgcgcaaaatttgcttttgatgcttattaagagtaaacccatgaatttgaatttttatattatgcttggtacttggaattgatatataccttattaaagcttgaaaacatttagcatttgaatagtaagtttcatcacaaatcatgtcttttgcctcttttgttacccaggttcgatcaaggggactggatgcccaagtgattttctctaataatcgggttgggacttaactttaaggtgttttcaatgtgattttagtatttacagtaataaataaaatttatacaaagtttcagagaactaccaactctctagttaattttgatgaagatgttttcattaatagtctggtttagtattaatttaaccttgaaataagaaattggtcctgatttgccaccttcatttttccatctgctgaaatgccatttcagaatgtataaaagtactttcagaattagaagaaaagtgagagcttcagcagaacgtgtcaagtcgctaataacaggagtcgaaccttatgtttgaaaattaactgagtgagttaagtgcaagcataaactaaaatttatatgactttgaatttaagaaccactaataactgtgttctaattaacacagtaatctgttcagccaaaggatactaacagccattctttggactgtggttaatttgataacttcaagaagttataactttgctaccctggattctgatgcaatttcaatataaaaagttgttcctttcatagtttttccccccaaaagaagtgcctattacattttaccttaatgtttatttatcatccaagtgttcttgatataaaatcagtatacagaaaattttaagagaacttacattcaagggacatagagggaaaatgttaatgtgtatttcattgtttcttgtggaatttttttttcattcggtttgagaatggacagtgtgtctaaggatgtgatttaaatttacttaggatggatttagcattgaggttattaagacaaagttagcagaggccagccagcactgtgctgcacaactccaggaactccatggtatgctcacaattttctgcaagttgcctccacttccaagtggccagtgatttgttaaaataccttgcccaagaatataactgattgatgaaagggcatatttaggtcaatataaaataatagcaagtatttactgagagcttactgtgtgctaggcattttcttaatatttcaatgtgtatttaatcctcacaacaacccaatgtggtaggttattgatatcctcttcttaaaaatgagtaaatggaggcccagagaaatgtaatttgcctgagatcaaattaaggttgcttaagatcaaactgctaagaaggggcagtttgagtctgagctagtgctcctaaacactggacatttttgctgtgaaccacagtcgggaaggtttaatgtttagactctttcctcagaggcttttaactacacacaattttgacatgttttccaagctcagaaagctcattaaaaacaactaaaactg

SEQ ID NO: 152149 - DNA, 557 bp, Homo sapiens
  Payload ID: 9943
  Gene Symbol: MED14
  Gene Name: mediator complex subunit 14
  ENST ID: ENST00000416199
  CDS Start-End: 1-468
gttgcaggaccaccatttaaagctaatacgttaatagccttcaccaagctattaggagctcctacacacatcctcagggattgtgtgcacattatgaagctggagctgttccctgaccaagcaacacagctaaaatggaatgttcagttttgcctgacgatccctcccagcgcgccgccgattgcacctcctgggacgcctgctgtggtgctgaaatccaaaatgctattttttcttcaactaactcagaaaacatcggtccctccccaagaacctgttagtattatagttccaatcatttatgacatggcttcaggtacaacccagcaggcagacattcccagacagcagaactcttctgttgctgctcccatgatggtcagcaacattctgaagaggtttgcagagatgaatccaccacgacaaggttcgatcaaggggactggatgcccaagtgattttctctaataatcgggttgggacttaactttaaggtgttttcaatgtgattttagtatttacagtaataaataaaatttatacaaagtttcagagaa

SEQ ID NO: 152150 - DNA, 1480 bp, Homo sapiens
  Payload ID: 9943
  Gene Symbol: MED14
  Gene Name: mediator complex subunit 14
  ENST ID: ENST00000433003
  CDS Start-End: 1-996
ccaagtggacgagcagggaactggccaggatctcctcaagtgtctggcccctcaccagcagcacgcatgcctggaatgtcaccagccaacccctcactacattctccggttccagatgcttctcattcccctcgagctggaacaagttctcaaacaatgccaacaaacatgcctccacctcgtaaactacctcagcgctcttgggcggcatccatacctaccatcctcactcacagtgccttgaacattttactgctgccctctccaactccaggccttgtgcccggcctggcaggtagttacctttgttctccacttgagagattccttggatcagtcatcatgagacgacatcttcaaagaattattcaacaagaaacgctgcagctgataaattctaatgaacccggagtgatcatgtttaagactgatgcactgaaatgcagagtagctcttagtcccaaaaccaaccaaacgcttcagctaaaagtgacacctgaaaatgcaggacagtggaaacctgatgaacttcaagttttggagaaattctttgaaacaagagttgcaggaccaccatttaaagctaatacgttaatagccttcaccaagctattaggagctcctacacacatcctcagggattgtgtgcacattatgaagctggagctgttccctgaccaagcaacacagctaaaatggaatgttcagttttgcctgacgatccctcccagcgcgccgccgattgcacctcctgggacgcctgctgtggtgctgaaatccaaaatgctattttttcttcaactaactcagaaaacatcggtccctccccaagaacctgttagtattatagttccaatcatttatgacatggcttcaggtacaacccagcaggcagacattcccagacagcagaactcttctgttgctgctcccatgatggtcagcaacattctgaagaggtttgcagagatgaatccaccacgacaaggtacatgaccagtagacaatattttattgcatatatgttataaaagttcttttgagagacacccctttctcctcttctcttctccctccttacctactctaccacccaatcatagcaatagaggtctggttgccgtggccctcttaatgtctgcctgtcgctttcttcctttctcactggttcttcatttttgtccatttctctgctgcctggactttttgttagtgatttactattgggactgacccagttgctaatgccagaagcttgtatttatagcacacattgccacaaagacctaggttaggatgatagaattttccacggctgtgaattcctgccctaccatcaatacctgccactctgtacatcacaaagttgaaatgcatgttggtttctcatatttcatggttcaatcacgaatagaagaatattattaaaagttctgtatcttctaaatgttttgtgaagaataaaagctgatacaaatgg

SEQ ID NO: 152151 - DNA, 3351 bp, Homo sapiens
  Payload ID: 9944
  Gene Symbol: MED15
  Gene Name: mediator complex subunit 15
  Uniprot ID: Q96RN5
  ENST ID: ENST00000263205
  CDS Start-End: 70-2436
ggctctgtgactgaggcggcggcggtggcggccaagcgggatacgggcggcgggagctggggaacaggcatggacgtttccgggcaagagaccgactggcggagcaccgccttccggcagaagctggtcagtcaaatcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccagatgatcacggaagccttggcccaaggtgggatgcacataagagcccggttcccgcctaccaccgctgtgtccgccatcccgtcaagctccatccctttgggcagacagcccatggcacaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgtt

SEQ ID NO: 152152 - DNA, 3252 bp, Homo sapiens
  Payload ID: 9944
  Gene Symbol: MED15
  Gene Name: mediator complex subunit 15
  Uniprot ID: Q96RN5
  ENST ID: ENST00000292733
  CDS Start-End: 78-2324
ttgggcctggctctgtgactgaggcggcggcggtggcggccaagcgggatacgggcggcgggagctggggaacaggcatggacgtttccgggcaagagaccgactggcggagcaccgccttccggcagaagctggtcagtcaaatcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgtttgtcagttgttca

SEQ ID NO: 152153 - DNA, 2235 bp, Homo sapiens
  Payload ID: 9944
  Gene Symbol: MED15
  Gene Name: mediator complex subunit 15
  Uniprot ID: Q96RN5
  ENST ID: ENST00000382974
  CDS Start-End: 39-2072
ccaagcgggatacgggcggcgggagctggggaacaggcatggacgtttccgggcaagagaccgactggcggagcaccgccttccggcagaagctggtcagtcaaatcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgcccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgta

SEQ ID NO: 152154 - DNA, 3210 bp, Homo sapiens
  Payload ID: 9944
  Gene Symbol: MED15
  Gene Name: mediator complex subunit 15
  ENST ID: ENST00000406969
  CDS Start-End: 129-2297
gactgaggcggcggcggtggcggccaagcgggatacgggcggcgggagctggggaacaggcatggacgtttccgggcaagagaccgactggcggagcaccgccttccggcagaagctgcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtg

SEQ ID NO: 152155 - DNA, 596 bp, Homo sapiens
  Payload ID: 9944
  Gene Symbol: MED15
  Gene Name: mediator complex subunit 15
  ENST ID: ENST00000445189
  CDS Start-End: 224-596
acatgcttgcctggtggtgaatgggacactttcaggcgagacctaggggagccccaggccagcaccaggacagagatctcgaggcctttccaactctgctggttcttcagaagtcaaaccaacagattggagtatgtgaaggaagctcgtgtattcttctgaactagcttagacaacagtacacagtttgaagggcagcagccttttctgcagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacaga

SEQ ID NO: 152156 - DNA, 3267 bp, Homo sapiens
  Payload ID: 9944
  Gene Symbol: MED15
  Gene Name: mediator complex subunit 15
  ENST ID: ENST00000433831
  CDS Start-End: 95-262
gcggacggcttccgggtttgggcctggctctgtgactgaggcggcggcggtggcggccaagcgggatacgggcggcgggagctggggaacaggcatggacgtttccgggcaagagaccgactggcggagcaccgccttccggcagaagctggtcagtcaaatcgaggatgccatgaggaaagctggtgtggcacacagtaaatccagcaaggatatggagagccatgttttcctgaaggccaagacccgggtaaggccctagacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtccgagctccgatggtggtgcagcagcccccagtgcagccccaggtgcagcagcagcagacagcagtacagacagctcaggctgcccagatggtggctcccggagtccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcagctctggccctgccccatctcccagtagcttcctgcccagcccctcaccgcagccctcccagagcccagtgacggcgcggaccccacagaacttcagtgtcccctcacctggacctttaaacacacctgtgaaccccagctctgtcatgagcccagctggctccagccaggctgaggagcagcagtacctggacaagctgaagcagctgtcgaagtacatcgagcccctgcgccgcatgatcaacaagatcgacaagaacgaagacagaaaaaaggacctgagtaagatgaagagccttctggacattctgacagacccctcgaagcggtgtcccctgaagaccttgcaaaagtgtgagatcgccctggagaaactcaagaatgacatggcggtgcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctggatgacaaggacctcccaagtgtgccaccactggagctcagtgtgcccgctgactatcctgcccaaagcccgctgtggatagaccggcagtggcagtacgacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgtt

SEQ ID NO: 152157 - DNA, 717 bp, Homo sapiens
  Payload ID: 9944
  Gene Symbol: MED15
  Gene Name: mediator complex subunit 15
  ENST ID: ENST00000414658
  CDS Start-End: 294-717
actgcggacggcttccgggtttgggcctggctctgtgactgaggcggcggcggtggcggccaagcgggatacgggcggcgggagctggggaacaggcatggacgtttccgggcaagagaccgactggcggagcaccgccttccggcagaagctggtcagtcaaatggtctcactctgtcactcaggctgaagtgcagtggcgtgattgtggctcactgcaacctccacctcctgggctcaagcgatcctcccacgtcagcctcccaagtagctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagc

SEQ ID NO: 152158 - DNA, 589 bp, Homo sapiens
  Payload ID: 9944
  Gene Symbol: MED15
  Gene Name: mediator complex subunit 15
  ENST ID: ENST00000424287
  CDS Start-End: 93-589
gttattggccagcctagctgagcactgacggctctcttccgagaggcggattccagaggaggccgagcaagcgtctgaatctgccttgcaggatgggcttcagctcggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagca

SEQ ID NO: 152159 - DNA, 590 bp, Homo sapiens
  Payload ID: 9944
  Gene Symbol: MED15
  Gene Name: mediator complex subunit 15
  ENST ID: ENST00000445987
  CDS Start-End: 231-590
agacgtaggcccgggggttcccggcctggccgggtagcagcgcgggggcggccctggggcggggagacagggggcggctccactccggcgctctgcggaggacagcagcgatcgccaaggctcactctatgatcagaagatggcataagtggggctgggcacagtggctcagtgcccagctgggattacgcctgtaataccagcactttgggaggccaagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacg

SEQ ID NO: 152160 - DNA, 418 bp, Homo sapiens
  Payload ID: 9944
  Gene Symbol: MED15
  Gene Name: mediator complex subunit 15
  ENST ID: ENST00000451058
  CDS Start-End: 103-418
gggcactggggcagtaaattggttgcaggattggaagaagtccaaggacagtgtgggatgccaccctgtagctgtctagagacctagtgaagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctg

SEQ ID NO: 152161 - DNA, 598 bp, Homo sapiens
  Payload ID: 9944
  Gene Symbol: MED15
  Gene Name: mediator complex subunit 15
  ENST ID: ENST00000432052
  CDS Start-End: 282-598
ttccgggtttgggcctggctctgtgactgaggcggcggcggtggcggccaagcgggatacgggcggcgggagctggggaacaggcatggacgtttccgggcaagagaccgactggcggagcaccgccttccggcagaagctggtcagtcaaatggtctcactctgtcactcaggctgaagtgcagtggcgtgattgtggctcactgcaacctccacctcctgggctcaagcgatcctcccacgtcagcctcccaagtagctgggaccacagcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgcccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagt

SEQ ID NO: 152162 - DNA, 581 bp, Homo sapiens
  Payload ID: 9944
  Gene Symbol: MED15
  Gene Name: mediator complex subunit 15
  ENST ID: ENST00000423862
  CDS Start-End: 1-581
attccagaggaggccgagcaagcgtctgaatctgccttgcaggatgggcttcagctcggacgaatacctttctctcgtggccaggctcattatccattttcgagacattcataacaagaaatctcaagcttccgtcagtgatcctatgaatgcactccagagcctgactggcggacctgctgcgggagccgctggaattgggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacagatacagcagcagcaacagcagctgcagcgaatagcacagctgcagctccaacaacagcaacagcagcagc

SEQ ID NO: 152163 - DNA, 551 bp, Homo sapiens
  Payload ID: 9944
  Gene Symbol: MED15
  Gene Name: mediator complex subunit 15
  ENST ID: ENST00000444094
  CDS Start-End: 139-303
atttcccacaagccctccttcacttccggctcggccgaggcactgcggacggcttccgggtttgggcctggctctgtgactgaggcggcggcggtggcggccaagcgggatacgggcggcgggagctggggaacaggcatggacgtttccgggcaagagaccgactggcggagcaccgccttccggcagaagctggtcagtcaaatcgaggatgccatgaggaaagctggtgtggcacacagtaaatccagcaaggatatggagagccatgttttcctgaaggccaagacccggatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaa

SEQ ID NO: 152164 - DNA, 573 bp, Homo sapiens
  Payload ID: 9944
  Gene Symbol: MED15
  Gene Name: mediator complex subunit 15
  ENST ID: ENST00000438962
  CDS Start-End: 217-573
gaatagggaaagggagagaagcagccggctgtagtgggtttagcagggctgggtgcttcatggtttctcttccagaaaagcgcatcaacggtgaaagaaagtgatgggaggagggtggatgtaagatgagattgggaaggtagttgtttggggtgtgggcggtgggacggaggatctgagggtgaccccccgaaggaatgtggactttgccgaaggatggcaggaagccgctgtcaggaagcgatcgtcgtttctggaggagagcgtgaagagctggggtcagtggccccgctcagaggaactctagcccctcaccaccgactgcttgtttctgttagcagtttttttcatgcgcgtccgtgtgaagagaccaccaaacaggctttgtggtctcactctgtcactcaggctgaagtgcagtggcgtgattgtggctcactgcaacctccacctcctgggctcaagcgatcctcccacgtcagcctcccaagtagctgggaccacagcgaggatgccatgaggaaagctggtgtggcacacagtaaatccagcaaggatatggagagccatgtt

SEQ ID NO: 152165 - DNA, 572 bp, Homo sapiens
  Payload ID: 9944
  Gene Symbol: MED15
  Gene Name: mediator complex subunit 15
  ENST ID: ENST00000428629
  CDS Start-End: 327-572
aatgaaagcccttctttacagatagtgcaaagacacagcggcccacccacggctgcctctgacaggccttgtgccctcaggccagcgcctcatcacccccaacctgcctgtcccctttgtgatgaagagagggcactcaagatggctcccagctctctcagctgagtgcctttccatcaggggagaggagtggccgttggaggctctctgtccccttcttgtttctttgtgcctgttattggccagcctagctgagcactgacggctctcttccgagaggcggattccagaggaggccgagcaagcgtctgaatctgccttgcaggatgggcttcagctcggacgaatacctttctctcgtggccaggctcattatccattttcgagacattcataacaagaaatctcaagcttccgtcagtgcccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttc

SEQ ID NO: 152166 - DNA, 840 bp, Homo sapiens
  Payload ID: 9944
  Gene Symbol: MED15
  Gene Name: mediator complex subunit 15
  ENST ID: ENST00000441501
  CDS Start-End: 226-411
aaccacactgaatagggaaagggagagaagcagccggctgtagtgggtttagcagggctgggtgcttcatggtttctcttccagaaaagcgcatcaacggtgaaagaaagtgatgggaggagggtggatgtaagatgagattgggaaggtagttgtttggggtgtgggcggtgggacggaggatctgagggtgaccccccgaaggaatgtggactttgccgaaggatggcaggaagccgctgtcaggaagcgatcgtcgtttctggaggagagcgtgaagagctggggtcagtggccccgctcagaggaactctagcccctcaccaccgactgcttgtttctgttagcagtttttttcatgcgcgtccgtgtgaagagaccaccaaacaggctttgtcgaggatgccatgaggaaagctggtgtggcacacagtaaatccagcaaggatatggagagccatgttttcctgaaggccaagacccgggacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagc

SEQ ID NO: 152167 - DNA, 623 bp, Homo sapiens
  Payload ID: 9944
  Gene Symbol: MED15
  Gene Name: mediator complex subunit 15
  ENST ID: ENST00000457322
  CDS Start-End: 142-623
agcaacaggctgggctgagaaatgaaagcccttctttacagatagtgcaaagacacagcggcccacccacggctgcctctgacaggccttgtgccctcaggccagcgcctcatcacccccaacctgcctgtcccctttgtgatgaagagagggcactcaagatggctcccagctctctcagacgaatacctttctctcgtggccaggctcattatccattttcgagacattcataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagacccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagtt

SEQ ID NO: 152168 - DNA, 430 bp, Homo sapiens
  Payload ID: 9944
  Gene Symbol: MED15
  Gene Name: mediator complex subunit 15
  ENST ID: ENST00000420849
  CDS Start-End: 21-131
gtctgaatctgccttgcaggatgggcttcagctcggacgaatacctttctctcgtggccaggctcattatccattttcgagacattcggacagtggcctggctggtgcacacagtcctgtggggctcatgaggtcatgggaagcagccgagcaggaggctcagggccccatgactgctacagaagttctccgctgggcactggggtcagctggactggcttccagctggccgtggacagcctcagtttcctcatctagataacaagaaatctcaagcttccgtcagtgatcctatgaatgcactccagagcctgactggcggacctgctgcgggagccgctggaattggcatgcctcctcggggcccgggacagtctctgggcgggatgggtagccttggtgccatgggacagccaatgtctctctcagg

SEQ ID NO: 152169 - DNA, 1199 bp, Homo sapiens
  Payload ID: 9945
  Gene Symbol: MED16
  Gene Name: mediator complex subunit 16
  ENST ID: ENST00000269814
  CDS Start-End: 134-790
ggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgcccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccc

SEQ ID NO: 152170 - DNA, 3229 bp, Homo sapiens
  Payload ID: 9945
  Gene Symbol: MED16
  Gene Name: mediator complex subunit 16
  Uniprot ID: Q9Y2X0
  ENST ID: ENST00000312090
  CDS Start-End: 127-2709
cgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagtttcccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctttcctagcacaggtccatgctctgtgtgggtgcttttgggatggcagccacttccaggtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgcccaggcccgcgtccctgccgtcggtgcccccgaccccacccacgacctcgatttggtgccgggagcctgtgtcctcttggcctgtctttaaatccttcagcatttatggggca

SEQ ID NO: 152171 - DNA, 2922 bp, Homo sapiens
  Payload ID: 9945
  Gene Symbol: MED16
  Gene Name: mediator complex subunit 16
  Uniprot ID: Q9Y2X0
  ENST ID: ENST00000325464
  CDS Start-End: 152-2785
cagaagtctttgggaggcggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagtttcccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccc

SEQ ID NO: 152172 - DNA, 3420 bp, Homo sapiens
  Payload ID: 9945
  Gene Symbol: MED16
  Gene Name: mediator complex subunit 16
  Uniprot ID: Q9Y2X0
  ENST ID: ENST00000395808
  CDS Start-End: 152-2677
cagaagtctttgggaggcggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagtttcccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgcccaggcccgcgtccctgccgtcggtgcccccgaccccacccacgacctcgatttggtgccgggagcctgtgtcctcttggcctgtctttaaatccttcagcatttatggggcacctagtggatgccgagtctgggggtatccaaagtgagcagtggggacaggacacagcaggccggtggatgggatggggcggccatcgtcagggtggcttctgtccaggcatctgcctttcagtgtgttgtctgcctgtctctatactgtctctgcgtgctctccttgtttctgcgtgtctctggtatctctgcacttctctgtgtatggtctctgtgtctctg

SEQ ID NO: 152173 - DNA, 2772 bp, Homo sapiens
  Payload ID: 9945
  Gene Symbol: MED16
  Gene Name: mediator complex subunit 16
  Uniprot ID: Q9Y2X0
  ENST ID: ENST00000589119
  CDS Start-End: 1-2634
atgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagtttcccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccca

SEQ ID NO: 152174 - DNA, 1403 bp, Homo sapiens
  Payload ID: 9945
  Gene Symbol: MED16
  Gene Name: mediator complex subunit 16
  ENST ID: ENST00000586017
  CDS Start-End: 18-1403
agctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctg

SEQ ID NO: 152175 - DNA, 927 bp, Homo sapiens
  Payload ID: 9945
  Gene Symbol: MED16
  Gene Name: mediator complex subunit 16
  ENST ID: ENST00000592373
  CDS Start-End: 92-316
cggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccagggcctgctctgttcctgcggggggacagcctgttccctgagctgtcgactcggctgacagcagttctgtgaccttcctggggtgggacacacaccggcttacctggagcctgcctggagtcatcgtcatcgtctgcaggctgtggtgccaggccgtgctgaccatgccccgtccccacagacctgacccgcatgatccacatcctggacacggagcacccctgggacctgcactcgatcccctcagagcaccacgaggccatcacctgcctggagtgggaccagtcagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaa

SEQ ID NO: 152176 - DNA, 635 bp, Homo sapiens
  Payload ID: 9945
  Gene Symbol: MED16
  Gene Name: mediator complex subunit 16
  ENST ID: ENST00000586342
  CDS Start-End: 488-635
ggggcctaaggagagtttggggcgaggctgaaggcgcttggtgggacttcgggggcggggcctggagtgggtttggggtcgccggggtggagcctggggactggggggctgtagaggcagggcctggagactgcggggttatcggtgcggggcctggagagggaatagggtccctagggtggagactggggactgcggagttataggggtctggagagggtagggggtccctgggatggaccctggagattgggggttataggggcggggcctgaagaggctatggggtccctgggatgaagcctcgtatttgggggcaataggggaagggcctggagagtacgtggggtccccggggtggagtctggggactggggagttttaggggttgggcctggagagctaagggcgttggaggctggacctggagagtacatgggacccctacggtgaagcctgagaatttagggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatgg

SEQ ID NO: 152177 - DNA, 1628 bp, Homo sapiens
  Payload ID: 9945
  Gene Symbol: MED16
  Gene Name: mediator complex subunit 16
  ENST ID: ENST00000592943
  CDS Start-End: 18-1628
agctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagtttcccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctg

SEQ ID NO: 152178 - DNA, 3181 bp, Homo sapiens
  Payload ID: 9945
  Gene Symbol: MED16
  Gene Name: mediator complex subunit 16
  ENST ID: ENST00000606248
  CDS Start-End: 150-2141
gaagtctttgggaggcggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagtttcccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagccctcccccacctcggagccctcccccacctcggagccctgccccacctcggagccctcccccacctcggagccctcctctccatgaagcctctgctggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccc

SEQ ID NO: 152179 - DNA, 2004 bp, Homo sapiens
  Payload ID: 9945
  Gene Symbol: MED16
  Gene Name: mediator complex subunit 16
  ENST ID: ENST00000607471
  CDS Start-End: 1-1517
gcgtggtgagcgagaagtgccgtatcgacacggagatcctgccctccctgttcatgcgctgcaccaccgacctcaaccgcaaggacaagtttcccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccaggtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccca

SEQ ID NO: 152180 - DNA, 492 bp, Homo sapiens
  Payload ID: 9945
  Gene Symbol: MED16
  Gene Name: mediator complex subunit 16
  ENST ID: ENST00000621073
  CDS Start-End: 1-238
tgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcgggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccca

SEQ ID NO: 152181 - DNA, 1078 bp, Homo sapiens
  Payload ID: 9945
  Gene Symbol: MED16
  Gene Name: mediator complex subunit 16
  ENST ID: ENST00000616387
  CDS Start-End: 18-677
agctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccct

SEQ ID NO: 152182 - DNA, 599 bp, Homo sapiens
  Payload ID: 9945
  Gene Symbol: MED16
  Gene Name: mediator complex subunit 16
  ENST ID: ENST00000606828
  CDS Start-End: 18-599
agctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctg

SEQ ID NO: 152183 - DNA, 554 bp, Homo sapiens
  Payload ID: 9945
  Gene Symbol: MED16
  Gene Name: mediator complex subunit 16
  ENST ID: ENST00000617672
  CDS Start-End: 18-425
agctggtgactgccctcatgtgtgatttgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccct

SEQ ID NO: 152184 - DNA, 1602 bp, Homo sapiens
  Payload ID: 9945
  Gene Symbol: MED16
  Gene Name: mediator complex subunit 16
  ENST ID: ENST00000633972
  CDS Start-End: 1-1115
ggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgactcgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccaggtcgcgatgagggcccagcgagcgagccggacgaggcgctggtggatgaatgctgcctgctgcccagccagctgcttatccccagcctggactggctgccagccagcgacggcctggtcagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaattgcctgtgcggtgggctctggtggcgggtgcccctcagctacccctgagcccagctgcccctcagctactcctcagctacccctcagctgctcctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccaaaggaccgtccgtgacggccgggggtccaggcggaccttgtggtgacccggctcgggcgtctcctcggtttccttgcctcacccacggagagcgctgaacctggacaagcagcggctgggaaggacaggtccaataaacgccctctgcgccca

SEQ ID NO: 152185 - DNA, 1631 bp, Homo sapiens
  Payload ID: 9945
  Gene Symbol: MED16
  Gene Name: mediator complex subunit 16
  ENST ID: ENST00000634212
  CDS Start-End: 1-1493
ggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgactcgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacttcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggtcagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaattgcctggctgttgaaggccgtgggccggacgcctgcgtgaccagcagagcttctgaggaagcccctgcctttgtccagctgggcccgcagtccacacaccactctcccaggacccccagatccctggaccatctgcatccaaaggaccgtccgtgacggccgggggtccaggcggaccttgtggtgacccggctcgggcgtctcctcggtttccttgcctcacccacggagagcgctgaacctggacaagcagcggctgggaaggacaggtccaataaacgccctctgcgccca

SEQ ID NO: 152186 - DNA, 1962 bp, Homo sapiens
  Payload ID: 9945
  Gene Symbol: MED16
  Gene Name: mediator complex subunit 16
  ENST ID: ENST00000633123
  CDS Start-End: 1-1442
ggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgactcgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacttcggatacccaggacagcatgtccctgctcttccgcctgctcaccaagctctggatctgctttcctagcacaggtccatgctctgtgtgggtgcttttgggatggcagccacttccaggtcgcgatgagggcccagcgagcgagccggacgaggcgctggtggatgaatgctgcctgctgcccagccagctgcttatccccagcctggactggctgccagccagcgacggcctggtcagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaattgcctgtgcggtgggctctggtggcgggtgcccctcagctacccctgagcccagctgcccctcagctactcctcagctacccctcagctgctcctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccaaaggaccgtccgtgacggccgggggtccaggcggaccttgtggtgacccggctcgggcgtctcctcggtttccttgcctcacccacggagagcgctgaacctggacaagcagcggctgggaaggacaggtccaataaacgccctctgcgcccaggcccgcgtccctgccgtcggtgcccccgaccccacccacgacctcgatttggtgccgggagcctgtgtcctcttggcctgtctttaaattcttcagcatttatggggca

SEQ ID NO: 152187 - DNA, 135 bp, Homo sapiens
  Payload ID: 9945
  Gene Symbol: MED16
  Gene Name: mediator complex subunit 16
  ENST ID: ENST00000631914
  CDS Start-End: 1-135
tcgctgctgcgcccccactttctcaacacgcctgacaagagccccggcgaccggctgaccgagatctgcaccaagatcaccgacgtcgacattgacaaggtcatgatcaacctcaagacggaggaatttgtgctg

SEQ ID NO: 152188 - DNA, 677 bp, Homo sapiens
  Payload ID: 9945
  Gene Symbol: MED16
  Gene Name: mediator complex subunit 16
  ENST ID: ENST00000631584
  CDS Start-End: 1-677
ggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgactcgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctg

SEQ ID NO: 152189 - DNA, 1891 bp, Homo sapiens
  Payload ID: 9945
  Gene Symbol: MED16
  Gene Name: mediator complex subunit 16
  ENST ID: ENST00000634211
  CDS Start-End: 1-851
ggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgactcgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagccctcccccacctcggagccctcccccacctcggagccctcccctccctcggagccctcccccacctcggagccctcctctccatgaagcctctgctggttccctgctgaggccgggccacagctttctgcgggacggcacctcgctgggcatgcttcgggaattgatggtggtcatccgcatctggggccttctgaagcccagctgcctgcccgtgtatacggccacttcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggtcagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaattgcctgtgcggtgggctctggtggcgggtgcccctcagctacccctgagcccagctgcccctcagctactcctcagctacccctcagctgctcctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccaaaggaccgtccgtgacggccgggggtccaggcggaccttgtggtgacccggctcgggcgtctcctcggtttccttgcctcacccacggagagcgctgaacctggacaagcagcggctgggaaggacaggtccaataaacgccctctgcgccc

SEQ ID NO: 152190 - DNA, 470 bp, Homo sapiens
  Payload ID: 9945
  Gene Symbol: MED16
  Gene Name: mediator complex subunit 16
  ENST ID: ENST00000632049
  CDS Start-End: 1-470
ggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaaggtcctctccacccggatcctggccatgaaggcctcgctctgcaagctgtcgccctgcacggtgactcgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctg

SEQ ID NO: 152191 - DNA, 492 bp, Homo sapiens
  Payload ID: 9945
  Gene Symbol: MED16
  Gene Name: mediator complex subunit 16
  ENST ID: ENST00000631904
  CDS Start-End: 1-238
tgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaattgcctgtgcgggctgttgaaggccgtgggccggacgcctgcgtgaccagcagagcttctgaggaagcccctgcctttgtccagctgggcccgcagtccacacaccactctcccaggacccccagatccctggaccatctgcatccaaaggaccgtccgtgacggccgggggtccaggcggaccttgtggtgacccggctcgggcgtctcctcggtttccttgcctcacccacggagagcgctgaacctggacaagcagcggctgggaaggacaggtccaataaacgccctctgcgccca

SEQ ID NO: 152192 - DNA, 2128 bp, Homo sapiens
  Payload ID: 9945
  Gene Symbol: MED16
  Gene Name: mediator complex subunit 16
  ENST ID: ENST00000631852
  CDS Start-End: 1-1385
ggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgactcgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacttcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggtcagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaattgcctgtgcggtgggctctggtggcgggtgcccctcagctacccctgagcccagctgcccctcagctactcctcagctacccctcagctgctcctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccaaaggaccgtccgtgacggccgggggtccaggcggaccttgtggtgacccggctcgggcgtctcctcggtttccttgcctcacccacggagagcgctgaacctggacaagcagcggctgggaaggacaggtccaataaacgccctctgcgcccaggcccgcgtccctgccgtcggtgcccccgaccccacccacgacctcgatttggtgccgggagcctgtgtcctcttggcctgtctttaaattcttcagcatttatggggcacctagtggatgccgagtctgggggtatccaaagtgagcagtggggacaggacacagcaggccggtggatgggatggggcggccatcgtcagggtggcttctgtccaggcatctgcctttcagtgtgttgtctgcctgtctctatactgtctctgcgtgctctccttgtttctgcgtgtctctggtatctctgcacttctctgtgtatggtctctgtgtctctg

SEQ ID NO: 152193 - DNA, 4874 bp, Homo sapiens
  Payload ID: 9946
  Gene Symbol: MED17
  Gene Name: mediator complex subunit 17
  Uniprot ID: Q9NVC6
  ENST ID: ENST00000251871
  CDS Start-End: 288-2243
gcaccgtgattcaccggaagcgctctagggaaccctggagcttccgcgcctgcccagttttgctccgaaagacttaccgaggagggagcttgcggtgcgttctgggaaagttgctgggccagctcctttgtttccagtctgagcgttgcgttcggtttcccgagggtcttctgaggcaccgcggctgcgggcttctgagttcccggctctccgcagggaagcctcctcttcgtacctcgttttttggctcgtggggggtcctcccaccgctggccgacgcagccagcatgtccggggtgcgcgcagtgcggatcagcatcgaatcggcctgcgagaagcaggtccatgaggtgggcctggatggcaccgagacgtacctgcccccgctgtccatgtcgcagaatctggcgcgtctggcccagcggatagacttcagccagggttcgggctccgaggaggaggaggcggcggggaccgagggcgacgcgcaggagtggccgggcgccgggtccagcgcagaccaggacgacgaggaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacagaatcctcagacgttgcaattgatatctaaaaagaagtcacttgctggagcagcacaaatcttattgaagggggcagaaagactgactaaatcagttaccgaaaaccaagaaaacaagctacaaagagacttcaattctgagcttttgcgattacggcaacactggaaacttcgaaaagttggagataaaattctcggagatctgagctacagaagtgcaggatctctctttcctcatcatggtacatttgaagtaataaagaatacagatctcgatctggataaaaagatacctgaagattactgtcctcttgatgtccaaattcctagtgatttagaggggtctgcatatatcaaggtttcaatacaaaaacaggctccagatataggtgacctcggcacagttaacctcttcaaacgacctttgcccaaatccaaaccaggttccccacattggcagacaaaattagaagcggcacagaatgttctcttatgtaaagaaatttttgcacagctctctcgggaagctgttcaaattaaatcacaagtccctcacattgtggtgaaaaaccagattatctctcagccctttccgagcttgcagttatctatttctttgtgccattcctcaaatgataagaaatcccaaaaatttgctactgagaagcaatgtccggaggaccacctttatgtcctagagcataatttgcatctactgattagagagtttcataaacagaccttgagttccatcatgatgcctcatccagcaagtgcaccttttggccacaagagaatgagactttcgggtcctcaagcttttgataaaaatgaaattaattcattacagtccagtgaagggcttctggaaaaaataattaaacaagcaaagcatatttttctaaggagtagagctgctgcaaccattgacagcttagcaagccgaattgaggatcctcagatacaggctcattggtcaaatatcaatgatgtttatgaatctagtgtgaaagttttaatcacatcacaaggctatgaacaaatatgcaagtccattcaactgcaattgaatattggagttgagcagattcgagttgtacatagagatggaagagtaattacactgtcttatcaggagcaggagctacaggattttcttctgtctcagatgtcacagcaccaggtacatgcagttcagcaactcgccaaggttatgggctggcaagtactgagcttcagtaatcatgtgggacttggacctatagagagcattggtaatgcatctgccatcacggtggcctccccaagtggtgactatgctatttcagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaatctccaaatacctttttttccccccaaatactttctaaactttttttttttgagatggtatctcactctgtagcccagtctggagtgcagtggtgtgatcatggttcactgcagtcttgacctcccaggcttaggtgatccttctgtctcagccttccgagtagctgggaccacaggcatgcacaaccacgcctggctaatttttgtattttttataaagacagggtttttccatgttgcccaggctggtttcgaactcggctcaagtgatctacctgcctctgcctcccaaagtgctaggattacaggcgtgagccaccatgcccagcctactctaaattattgataacctcttcctccagttgtctcctttaagctttcctgggtctaacctacataggtaatttaagaacatcctcagaaaggacagctgaaggcaataggaggcagattatctctttagggcgtcctcaagtttttttggtctgttctcccacttgattgacctcaccagttgagacacctagtgtatggctcatgcccagccttccacctgggattctccagcctccacccagcagccctggattgctttctccaattaaggcctttccatcagctctctgctttttcaaagcgaaaaaactaatggattagtgggttatcttttccaaggaacaggtttgcacttcttggaaaaagtgcctaaagtgtgcccattaatatgaggatagatttaggctcataagccttttggtaacactgaaagtagtatcatataggcaagctctccttataagtaaggctttcaatttttaaaacagacatcctgctttaacaatttgtaagatgactgtgcagtaataaaagtcctttgtatttctccaccgtgttttcattaaagaaaaatggagcttgtgggccacgatagaacaactttgtgcttttttccccttctgatcaagatcttgcatctttctatccatggaaattaaaataattggtatgaatttgcagttatttaaaaatcttgagtgcttcaaaaattattgttgcctgcaaaatttgccttggtcaataggctaatctgcacaattccactcacataaggagtcttttatgtgattttgaaggctcaggctagaagagtgagtctgagacttttgctgaatgaccagtttttgtttatataaacttctcccattgcagattgatactttggtaaactaataaaaatgaattcctaaaatgaaattttgaaaagatacaaaataaaagccccatttatttgattataacttgattaaattgcatcaaatactagaatttatagacagagtctcactctgttccccaggctggagtgcagcagcactgttttggctcactgcaacctctgcctcctgggttcaaatgactctcatgcctcagcctcccgagtaactgggattacaggtgtgtgccaccacgaccgtctaatttttgtaattttgataagagggttttgccatcttggccaggctggtcttgaactcctggcctcaattgatccgcccacctcggcctcccaaagtgctaggattacaggcataagccacagtgcccagcccccccaaatataaacatttctgaatgctttattttttatttctctgcttgtcatgaatcagtaacaaatcatggaccaggaccacaccttgagtagaatggctgagaatacatgtgcagatactaccgtctgttcttttaaaccccatctgagtagagtgggataactgaagactttacgttcttcatgtcttactttccctgtttggtacgtcgctgtagtgagtagccagtaccgacctaaagaattgtagaaactaaagcaaatgtgtgggaaaatggtagcttagttgctgtggtagcaattcttatgccttgtatttatttacattttctagtttaatgttttaacctgaatttcctggagtttgaaggatgtgctatggaaacttgggagacagtttgaagaaaaccaattagcccctcaacaagtattaacaggttggcaaggagctgtgtttgaatcttggctctgctactggcttgctgtatgaacttggcaaggattctctgtgaacttgtttccttatatataaatgaagatagaggtgcctcctctactaacctcagtggtgattgagaagtttcagtaacgttggtaataaatgttaaattctaaagtactacataaatataaagcattaagcaagtgtgcttctaagagtcaagccaattagaaaaa

SEQ ID NO: 152194 - DNA, 847 bp, Homo sapiens
  Payload ID: 9946
  Gene Symbol: MED17
  Gene Name: mediator complex subunit 17
  ENST ID: ENST00000533359
  CDS Start-End: 153-847
agtctgagcgttgcgttcggtttcccgagggtcttctgaggcaccgcggctgcgggcttctgagttcccggctctccgcagggaagcctcctcttcgtacctcgttttttggctcgtggggggtcctcccaccgctggccgacgcagccagcatgtccggggtgcgcgcagtgcggatcagcatcgaatcggcctgcgagaagcaggtccatgaggtgggcctggatggcaccgagacgtacctgcccccgctgtccatgtcgcagaatctggcgcgtctggcccagcggatagacttcagccagggttcgggctccgaggaggaggaggcggcggggaccgagggcgacgcgcaggagtggccgggcgccgggtccagcgcagaccaggacgacgaggaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacaggatagggggctggcaatatataaggagaggaatggcagtacattaagaggggaccctaacaggctggacagagttgatgcaatgaatcctcagacgttgcaattgatatctaaaaagaagtcacttgctggagcagcacaaatcttattgaagggggcagaaagactgactaaatcagttaccgaaaaccaagaaaacaagctacaaagagacttcaattctgagcttttgcgattacggcaacactggaaacttcgaaaagttggagataaaattct

SEQ ID NO: 152195 - DNA, 2491 bp, Homo sapiens
  Payload ID: 9946
  Gene Symbol: MED17
  Gene Name: mediator complex subunit 17
  ENST ID: ENST00000533133
  CDS Start-End: 104-904
ctgcgggcttctgagttcccggctctccgcagggaagcctcctcttcgtacctcgttttttggctcgtggggggtcctcccaccgctggccgacgcagccagcatgtccggggtgcgcgcagtgcggatcagcatcgaatcggcctgcgagaagcaggtccatgaggtgggcctggatggcaccgagacgtacctgcccccgctgtccatgtcgcagaatctggcgcgtctggcccagcggatagacttcagccagggttcgggctccgaggaggaggaggcggcggggaccgagggcgacgcgcaggagtggccgggcgccgggtccagcgcagaccaggacgacgaggaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacagaatcctcagacgttgcaattgatatctaaaaagaagtcacttgctggagcagcacaaatcttattgaagggggcagaaagactgactaaatcagttaccgaaaaccaagaaaacaagctacaaagagacttcaattctgagcttttgcgattacggcaacactggaaacttcgaaaagttggagataaaattctcggagatctgagctacagaagtgcaggatctctctttcctcatcatggtacatttgaagtaataaagaatacagatctcgatctggataaaaagatacctgaagattactgtcctcttgatgtccaaattcctagtgatttagaggggtctgcatatatcaaggtatttgtcaaaatatttttcaagtaatttcttacgaatagcctgaagttaatttgttaactttttttgtttttgttgtcatataggtttcaatacaaaaacaggctccagatataggtgacctcggcacagttaacctcttcaaacgacctttgcccaaatccaaaccaggttccccacattggcagacaaaattagaagcggcacagaatgttctcttatgtaaagaaatttttgcacagctctctcgggaagctgttcaaattaaatcacaagtccctcacattgtggtgaaaaaccagattatctctcagccctttccgagcttgcagttatctatttctttgtgccattcctcaaatgataagaaatcccaaaaatttgctactgagaagcaatgtccggaggaccacctttatgtcctagagcataatttgcatctactgattagagagtttcataaacagaccttgagttccatcatgatgcctcatccagcaagtgcaccttttggccacaagagaatgagactttcgggtcctcaagcttttgataaaaatgaaattaattcattacagtccagtgaagggcttctggaaaaaataattaaacaagcaaagcatatttttctaaggagtagagctgctgcaaccattgacagcttagcaagccgaattgaggatcctcagatacaggctcattggtcaaatatcaatgatgtttatgaatctagtgtgaaagttttaatcacatcacaaggctatgaacaaatatgcaagtaagttggagtgcagtgatgatcatatctgactacagccttgagctccggggttcaaggaattcttttgcctcaacctcctgagtagctgggactataggcatgtgcccccatgcccagctaattaaaaaaattttttttaagaaacatgtctatgttgcccatgctggtcttgaactcctggactccagcaatcctgctgtcttggcctcccaaagtgctgggattacaggcatgagccaccactcccggccctttgtattgatattttggtttttctccacagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaa

SEQ ID NO: 152196 - DNA, 530 bp, Homo sapiens
  Payload ID: 9946
  Gene Symbol: MED17
  Gene Name: mediator complex subunit 17
  ENST ID: ENST00000528786
  CDS Start-End: 102-530
gtcatctttttgttgctgccggacaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacagaatcctcagacgttgcaattgatatctaaaaagaagtcacttgctggagcagcacaaatcttattgaagggggcagaaagactgactaaatcagttaccgaaaaccaagaaaacaagctacaaagagacttcaattctgagcttttgcgattacggcaacactggaaacttcgaaaagttggagataaaattctcggagatctgagctacagaagtgcaggatctctctttcctcatcatggtacatttgaagtaataaagaatacagatctcgatctggataaaaagatacctgaagattactgtcctcttgatgtccaaattcctagtgattta

SEQ ID NO: 152197 - DNA, 2278 bp, Homo sapiens
  Payload ID: 9946
  Gene Symbol: MED17
  Gene Name: mediator complex subunit 17
  Uniprot ID: Q9NVC6
  ENST ID: ENST00000530819
  CDS Start-End: 233-670
agttttgctccgaaagacttaccgaggagggagcttgcggtgcgttctgggaaagttgctgggccagctcctttgtttccagtctgagcgttgcgttcggtttcccgagggtcttctgaggcaccgcggctgcgggcttctgagttcccggctctccgcagggaagcctcctcttcgtacctcgttttttggctcgtggggggtcctcccaccgctggccgacgcagccagcatgtccggggtgcgcgcagtgcggatcagcatcgaatcggcctgcgagaagcaggtccatgaggtgggcctggatggcaccgagacgtacctgcccccgctgtccatgtcgcagaatctggcgcgtctggcccagcggatagacttcagccagggttcgggctccgaggaggaggaggcggcggggaccgagggcgacgcgcaggagtggccgggcgccgggtccagcgcagaccaggacgacgaggaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacaggtatttgtggactttaattgaataataaaattttatttattaaatcccaggacccttttttggctttgtgcctgttgttccattttcctttcttgcaaaattaagtccagatgaagatttaaagactaactggtctaaaacaaagccatacaactgcatttcctttatttttttattatatacctatgatccttggaagagttaagtttcattaagaatgtaatacctttaaggccaggcgtggtggctcacgcctgtaatcccagcactttgggaggccaaggcgggcagatcacgaggtcaggagatcgagaccatcctggctaatgctgtgaaaccttgtctctattaaaaataacaaaaataagccaggcgtggtggtgggcacctgtagtcccagctactcagaaggctgaggcaggagaattgcttgagcctgggaggcgggggttgcagtgagctgagatcgcgccactgcactccagcctgggcgacagagcgagattccatcccaaaaaaaaaaaaaaaaagaatgtaatactttaaaggttaccaaatcttaacaaattcttatagcctgggtccttggtctgtgatatattacacaaaaatgtgatgatataatggctttggaatcaggtagacctggattcgaatcctgcctctgccttcattaactgtgtgaccttaaattaagcaagttattttctcttaagtccctgtttttccatctaatccttccttccctttttttttaagggatggattagaaaagttaggcgaaattatggagcatattgagagctgggtagaattgctgctatttcataaacagtgtattcaatttttgaacatttgaagatgaaagagaagtagcaggaagatgagttggtgaatagtctgaaatcattgaggctacttgggtccttaaggaaaacaagtgtcaagaccataaccaaattagtcatggagaagaagtaatgactgttagaacccatttgtaaataaaattaattgaatagaattactcacatagtaatagtttcagaatctagaaacattgtgctgggggactaatagagttccctaaatctgcattcttcattttatagagagaaaactaaagcttaaagagatttgtaatatgttcaagttgctgtcaagccagtagttagggagccaagactagaactccagcacctaactcatagccccactgccttttctactattctgtgcttttcccagaagggagtctccaggaatttcttaatatctccaggaactcttttatttacgttccctaatacaatcaaaagattattttgatatgtttatgaagctttttatgtgatttttgactctcatacagccagaaaactgtattaaactggttagtaaaatacacaaattatggtgattgtggatatttatatatgcatatgtgatacatagatagtgacttctgatcagttttccaaaaaattaggattcagtgaagtacatttaatattaacaatggcagggcacggtggcttatgcctgtaattccaacactttggggaaccaaagcaggaagccaggagtttgagactttcccaggcaacatagcaagaccctgtctctacc

SEQ ID NO: 152198 - DNA, 1833 bp, Homo sapiens
  Payload ID: 9947
  Gene Symbol: MED18
  Gene Name: mediator complex subunit 18
  Uniprot ID: Q9BUE0
  ENST ID: ENST00000373842
  CDS Start-End: 210-836
gaagttggctggttgcaccgatctgggggcttcccgggctcgggtaaccggagtgctggtatctaatcgtcgctcaaaagctcctaggtgcgcgggtggatataattcccggcttctcgagaagacactacagcctcaaggaggtatatcccgtgccttacctgactgggggctctgagtccagttgtgttgtcttcaacttagacaccatggaggcacctccagtcaccatgatgcctgtcactgggggcaccattaacatgatggagtacctgttgcagggaagtgttttagatcacagtttggaaagcctcatccaccgccttcgtggtttgtgtgacaacatggaacctgagactttccttgaccatgagatggtattcctccttaagggccagcaagccagcccatttgttctcagggcccgacgctctatggacagggcaggggcaccctggcatctgcgctacctgggacagccagaaatgggagacaagaaccgccatgccctggtgcgaaactgcgtggacattgccacatctgagaacctcaccgacttcttgatggaaatgggcttccgcatggaccatgagtttgttgctaagggacatttgttccgtaagggcatcatgaagattatggtgtacaagattttccgcatcctggtgccagggaacacagacagcactgaggccttgtcactctcctatctcgtggaattaagtgtggtagcacccgctgggcaggacatggtctctgatgacatgaagaacttcgcagaacagctaaaacctctggttcacctagagaaaatagaccccaagaggctcatgtgactaagaggatctgtccacatttggggcctatccttacttgtttgaaaaaatatgtttgctttttttggtttttgttttgttttgtttttgagacagagtctcgctttgtttcccaggctggagtgcagtggcacgatctcggctcactgcaacctctgcctcctgggttcaagcaattctcccacctcagcctcctgagtagctgggattacaggcacatgccaccatgctcagctaatttttgtatttttagtagaaatggggattcaccatgttggtcaggctattctcgaactcctgacctcgtgatccacccaccttggcctcccaaagtgctgggattacaggcatgagccaccacgcctggccaaaaaaatatgttttaaatgtcccatttcaccattgccaggcaggcattcttccttcagggagaggatggtgagaattaattggttctttgcactgttctcctcatgtggcgatttcactttcatgacagcctttctatattaaaggctcaggatgtcacggagaatctatctaatcccactgtattaagaggggaaaccgggccaagcgcagtggctcacacctctaatcccagcactttgggaggctgaggtaggtggatcacccaaggtcaggagtttgagaccagcctggccaaatggtgaaaccccatctctacgaaaaatacaaaatttagccgggcatggtagcaggcgcttgtaatcccagctacttgggaggctgaggctggagaatcgcttgaacccaggaggtgaaggttgcagtgaccagagatgacgccattgcactccagcctgggtgagaagagcgaaactccgtctcaaaaaaaaataaaaatgaagaggggaaaccagaataaattatcttttggaaaggacaatttcttgtttggccatttgtgtataaggttggtaacattagaggctgtgagcttgtgttacatggtaataaagccaatgaagagaca

SEQ ID NO: 152199 - DNA, 1106 bp, Homo sapiens
  Payload ID: 9947
  Gene Symbol: MED18
  Gene Name: mediator complex subunit 18
  Uniprot ID: Q9BUE0
  ENST ID: ENST00000398997
  CDS Start-End: 193-819
ccgatctgggggcttcccgggctcgggtaaccggagtgctggtatctaatcgtcgctcaaaagctcctaggtgcgcgggtggatataattcccggcttctcgagaagacactacagcctcaaggaggtatatcccgtgccttacctgactgggggctctgagtccagttgtgttgtcttcaacttagacaccatggaggcacctccagtcaccatgatgcctgtcactgggggcaccattaacatgatggagtacctgttgcagggaagtgttttagatcacagtttggaaagcctcatccaccgccttcgtggtttgtgtgacaacatggaacctgagactttccttgaccatgagatggtattcctccttaagggccagcaagccagcccatttgttctcagggcccgacgctctatggacagggcaggggcaccctggcatctgcgctacctgggacagccagaaatgggagacaagaaccgccatgccctggtgcgaaactgcgtggacattgccacatctgagaacctcaccgacttcttgatggaaatgggcttccgcatggaccatgagtttgttgctaagggacatttgttccgtaagggcatcatgaagattatggtgtacaagattttccgcatcctggtgccagggaacacagacagcactgaggccttgtcactctcctatctcgtggaattaagtgtggtagcacccgctgggcaggacatggtctctgatgacatgaagaacttcgcagaacagctaaaacctctggttcacctagagaaaatagaccccaagaggctcatgtgactaagaggatctgtccacatttggggcctatccttacttgtttgaaaaaatatgtttgctttttttggtttttgttttgttttgtttttgagacagagtctcgctttgtttcccagcctgggtgagaagagcgaaactccgtctcaaaaaaaaataaaaatgaagaggggaaaccagaataaattatcttttggaaaggacaatttcttgtttggccatttgtgtataaggttggtaacattagaggctgtgagcttgtgttacatggtaataaagccaatgaagag

SEQ ID NO: 152200 - DNA, 1515 bp, Homo sapiens
  Payload ID: 9948
  Gene Symbol: MED19
  Gene Name: mediator complex subunit 19
  Uniprot ID: A0JLT2
  ENST ID: ENST00000337672
  CDS Start-End: 23-607
cagcgccggggcggagggtacgatggagaatttcacggcactgtttggggctcaggctgacccaccaccgcccccaaccgcactcggcttcggaccaggaaagcctccacccccgccaccgcctcctgcgggcgggggacccggcacggccccgcctcccaccgcggccacggctcctcctggcgcggacaagtcaggagctggctgtggccctttttacctcatgagggaactgccaggtagcacagagctgacaggcagcacgaatctgatcacacactacaacttggaacaagcctataataaattctgtgggaagaaggtgaaggagaagctaagtaacttcctgcctgacctgccagggatgattgatctgcctggttcccatgataacagcagcctccgctctctcattgagaagccccctattctcagtagctctttcaatcctatcacagggaccatgctggccggcttccgcctccacactggcccgttgccggagcagtgtcgtctgatgcatattcagcctcccaagaagaagaataagcacaagcacaaacagagccgtacccaggatcctgtccccccaggtaaacccagttaagttccgtatggagctctggactcctaaattcccctgaagaagaaaccaatgtactgtggtctcttgggacttgggacagggactctagcagcacctctgtatcctttctggccatttggacaaaagcagttgccccgacttgggattttcctgtagtcttcagtggttcataacagtagaggattttgagctttacaggtgataggtacctaatgtctcctacagaaacaccatctgattcagatcacaagaagaagaaaaagaaaaaagaagaggatcctgaacggaaaaggaagaagaaagagaagaagaaaaagaaggtagagtagaggcctattgccacaacccagtgagtttccccagatctcacccctgtcctaaataccctagagttctttgcctcaagttggacccaagattgaaaacccaaggcaggttgcaggtttctcctgtacagcctgatcaaagccaaggctagttcctagttgttcttaccctgcttctttctcccccagaatcgacatagtccagaccacccaggtatgggcagctcccaggccagcagcagcagcagcctacgctaataggaccactggactctttgccaggatggcttttcctgctgtactgaacctgctgataaaagctgccttccaggctcttggacactgccttgggagcatcctgcagctgggacagaggccagctcctgttgggctcagttgagactaagtaaattaggagagagagggacatgcttttgtaggctcatcccagttggttttctcatggacatctcttcctctcccaggaagcttacaattttcttctctctcttttgtgcaatttgtctgatttaggacttgttctgtgttttctttaaaaaaaaaaaaattacatttatcaaa

SEQ ID NO: 152201 - DNA, 1089 bp, Homo sapiens
  Payload ID: 9948
  Gene Symbol: MED19
  Gene Name: mediator complex subunit 19
  ENST ID: ENST00000431606
  CDS Start-End: 31-765
cacggagacagcgccggggcggagggtacgatggagaatttcacggcactgtttggggctcaggctgacccaccaccgcccccaaccgcactcggcttcggaccaggaaagcctccacccccgccaccgcctcctgcgggcgggggacccggcacggccccgcctcccaccgcggccacggctcctcctggcgcggacaagtcaggagctggctgtggccctttttacctcatgagggaactgccaggtagcacagagctgacaggcagcacgaatctgatcacacactacaacttggaacaagcctataataaattctgtgggaagaaggtgaaggagaagctaagtaacttcctgcctgacctgccagggatgattgatctgcctggttcccatgataacagcagcctccgctctctcattgagaagccccctattctcagtagctctttcaatcctatcacagggaccatgctggccggcttccgcctccacactggcccgttgccggagcagtgtcgtctgatgcatattcagcctcccaagaagaagaataagcacaagcacaaacagagccgtacccaggatcctgtccccccagaaacaccatctgattcagatcacaagaagaagaaaaagaaaaaagaagaggatcctgaacggaaaaggaagaagaaagagaagaagaaaaagaagaatcgacatagtccagaccacccaggtatgggcagctcccaggccagcagcagcagcagcctacgctaataggaccactggactctttgccaggatggcttttcctgctgtactgaacctgctgataaaagctgccttccaggctcttggacactgccttgggagcatcctgcagctgggacagaggccagctcctgttgggctcagttgagactaagtaaattaggagagagagggacatgcttttgtaggctcatcccagttggttttctcatggacatctcttcctctcccaggaagcttacaattttcttctctctcttttgtgcaatttgtctgatttaggacttgttctgtgttttctttaaaaaaaaaaaaattacatttatcaaa

SEQ ID NO: 152202 - DNA, 2438 bp, Homo sapiens
  Payload ID: 9949
  Gene Symbol: MED20
  Gene Name: mediator complex subunit 20
  Uniprot ID: Q9H944
  ENST ID: ENST00000265350
  CDS Start-End: 82-720
ggaactgaaggagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtgctgactttcaggtccctggaccccagaaacccagggtagacatggactctactctccttctctggttctcagctgtggcttttgttctggggctgagtcccctccccaaccccctgactctcacacatagccccccatcagctgttttactccgtgccttactggatttggcctgtcctcaagaatggtaattatgaagagtggagaagtttggaccttgcctcctttaggggaaaggtaggacaggaatgtccctgcctggtactggtgggggaaatagtccgtatccccaactattaaggatttgtcccaggccaatggtgaacatgctgcattttatgtttggattgtgctgtaataagagcctcttccttccctcagaggatgtggctgggcttctatcctagagatggagtagaaggcacaactggtttgatagttactattttctgacctgtttgctgaagtgatttgcgaattgactttcctagggtgttgcctgagtcctttgaaatctccttctgacatctttcccttctgttgtgaaatatgttaagccacaggccaaactgctataagatcgaagtttgtttttttctcacctaataatagagaggtaatcagatggtctagggcagatttaactctacaaggttatcaggaactttgtttccttctgtcttattcagccattcccagtatgttttcttacccataagatcaaagcagactcatcagctccatatctgcattccactggggaaagagagagagaaaagagcagattttaaaaaaaagatatgactgagcattgctcagatcactgtggccacactttgctgaaagagatgctgggacatagaacctcttatctgggcagtcatgtgctgagttaaaactcagggattctgtgactacaagatgaaagacaatttggttgctgagatgcagttaatggcttctgttacatggagctcaatggacgtgcccaggaatgcttttggctgttattttgcagttaatacctcctgtaactaaagcatttgtttatgagttgacttgagagaagggctgatctcagagccgctttgagctaagttggattagtcacactaggaagttaattccacacctttcgtctaagtctcagtattgaggcctctccagttctcatgcaccctgatcttagggttagaatacttgaccctgatacctgcaccatgcttcatggttcctgagctctttctcctgtttcatttgagcctccaaactacatatttggtcatattgcctgcctaccccatgcctgctgcagaaatattcatccaggttaaccttgatatacacagagatggtcttggagaattgtgaatgtatgtactgtattgtcatcaaggatactgtcccttatttgaaggcatctaaagagaaactgttttcagatccaagtgctcagatctaaagcctctgcaacaagtcaggtggtggtcatgtttcccttctagttttggctgacaggaagctcagttcagtaccataactacagaacctgtcatctgtattttttgttctcaccccgtttttgttattttgtttctggttttttatattgaggtatgttttagatatagtttacaaaaataaaacgcacagatctta

SEQ ID NO: 152203 - DNA, 531 bp, Homo sapiens
  Payload ID: 9949
  Gene Symbol: MED20
  Gene Name: mediator complex subunit 20
  ENST ID: ENST00000394251
  CDS Start-End: 112-531
ctggtgcgagaatcctgagaactgtgctccagttcttagaggggctctcagggactgtggtcctctattccttgtctttacaatgggggactggtccaagttgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtggagtatggcccctgtgtg

SEQ ID NO: 152204 - DNA, 815 bp, Homo sapiens
  Payload ID: 9949
  Gene Symbol: MED20
  Gene Name: mediator complex subunit 20
  ENST ID: ENST00000409060
  CDS Start-End: 76-513
gaaggagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtaagaccttggtgaaaataggagcaggatgttctgagggggctgcttagcaaagggctctgaagattttccagttcttctctttttttttttttgagacagagtcttgttctgtcacccaggctggaatgcaatggcacaatcttggcacactgtagcctcgacctccagggctcaagtgatccttccgcctcagtctcccaagtacctgggactacacccaccgaattaaatttttttttttttttagtagaaatgaggtcttactatgttgcccaggctgatctcagactcctgggctcaattgatcctcccat

SEQ ID NO: 152205 - DNA, 932 bp, Homo sapiens
  Payload ID: 9949
  Gene Symbol: MED20
  Gene Name: mediator complex subunit 20
  Uniprot ID: Q9H944
  ENST ID: ENST00000409312
  CDS Start-End: 102-473
gagacagaaggttgtgttggggaactgaaggagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtgctgactttcaggtccctggaccccagaaacccagggtagacatggactctactctccttctctggttctcagctgtggcttttgttctggggctgagtcccctccccaaccccctgactctcacacatagccccccatcagctgttttactccgtgccttactggatttggcctgtcctcaagaatggtaattatgaagagtggagaag

SEQ ID NO: 152206 - DNA, 307 bp, Homo sapiens
  Payload ID: 9949
  Gene Symbol: MED20
  Gene Name: mediator complex subunit 20
  ENST ID: ENST00000434077
  CDS Start-End: 126-307
tgttggggaactgaaggagtttctgtgggcggacagggaaccctgcgtttctactgtgtgattctgccaccttcctggcccgacgccatgggagtgacttgggctgttgaatagcactttctgtgatgatggaaatgttctctaacaacagtgtccaatacactagtcccagccacctgtggctctgggctactgtgctgaacagctcaagttcacagagttgtgtgtcccagatgcctgtggccgagggcaagagtgttcagcaaaccgtagagctccttacccggaaattggagatgcttggggc

SEQ ID NO: 152207 - DNA, 805 bp, Homo sapiens
  Payload ID: 9949
  Gene Symbol: MED20
  Gene Name: mediator complex subunit 20
  ENST ID: ENST00000613074
  CDS Start-End: 82-717
ggaactgaaggagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggccagtgcccgggatctctgtggaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtgctgactttcaggtccctggaccccagaaa

SEQ ID NO: 152208 - DNA, 1753 bp, Homo sapiens
  Payload ID: 9950
  Gene Symbol: MED21
  Gene Name: mediator complex subunit 21
  Uniprot ID: Q13503
  ENST ID: ENST00000282892
  CDS Start-End: 31-465
gttttggcgtctgtttgctgcggtaggaacatggcggatcggctcacgcagcttcaggacgctgtgaattcgcttgcagatcagttttgtaatgccattggagtattgcagcaatgtggtcctcctgcctctttcaataatattcagacagcaattaacaaagaccagccagctaaccctacagaagagtatgcccagctttttgcagcactgattgcacgaacagcaaaagacattgatgttttgatagattccttacccagtgaagaatctacagctgctttacaggctgctagcttgtataagctagaagaagaaaaccatgaagctgctacatgtctggaggatgttgtttatcgaggagacatgcttctggagaagatacaaagcgcacttgctgatattgcacagtcacagctgaagacaagaagtggtacccatagccagtctcttccagactcatagcatcagtggataccatgtggctgagaaaagaactgtttgagtgccattaagaattctgcatcagacttagatacaagccttaccaacaattacagaaacattaaacactatgacacattacctttttagctatttttaatagtcttctattttcactcttgataagcttataaaatcatgattgaatcagctttaaagcatcataccatcattttttaactgagtgaaattattaaggcatgtaatacattaatgaacataatataaggaaacatatgtaaaattctgttatgacataatttatgtctccattttgttgtattggccagtacttttacaaatcaaaacatctctcaagccaaaggagaagacagtaagaacagacataagggacattttagtttgggctagtgtcctgcctcttagaggtggcattgtgtaaatctgagctttgagcaagaaagttttggaaattgtgttgcttttaagaaatagagttagtgtggctggataagaaagtcacatttatgcaaatgtttcttctgctagaacctcatacctgttctagttcatctccacgtttattttaccaagagatcctctgtcaagagaatttcctggctgttgtgaaagaatttttctacatcctgaactatttttcctatttcttttcaccttgctttttttcatccttaatttgcttgtcatcacaatgaagtatgttttttgaatcatcaattctttctcattctccatttatctgaaggttcttttgcccttattaacctctcaacttttattgctgtattctagtcagaccagaacatacttccactacatcagttacttggcatcatttcacctcagtttattattgccaaataataatttgtgtcagcattttcaactatggttattcatccaacccttggatctctttgagtctactgataatctccactggaaaggtggaattgaaatgtggtccacattttaactagctatttcctggggctgtatttttcagaatatgctgagctacatttgctgcaatctgttgctattcagagtttaagtttcaggagaaaacaggaacaatagaacactctgcctgttatttttgttgtaatcaagcttttccacagttcttgaaaagtactatgtttcaaatttcaggaacaccagcgttagctgtaaaagttgcagcaatttattggctagtcatagaaaatttttgaacttttaactgtattttaattgatgtttattaaaaacactttgctatcag

SEQ ID NO: 152209 - DNA, 575 bp, Homo sapiens
  Payload ID: 9950
  Gene Symbol: MED21
  Gene Name: mediator complex subunit 21
  ENST ID: ENST00000546323
  CDS Start-End: 35-514
agctgttttggcgtctgtttgctgcggtaggaacatggcggatcggctcacgcagcttcaggacgctgtgaattcgcttgcagatcagttttgtaatgccattggagtattgcagcaatgtggtcctcctgcctctttcaataatattcagacagcaattaacaaagaccagccagctaaccctacagaagagtatgcccagctttttgcagcactgattgcacgaacagcaaaagacattgatgttttgatagattccttacccagtgaagaatctacagctgctttacaggctgctagcttgtataagctagaagaagaaaaccatgaagctgctacatgtctggaggatgttgtttatcgaggagacatgcttctggagaagatacaaagcgcacttgctgatattgcacagtcacagctgaagacaagaagtggtgaagtctctgtcacccaagctgaagtgcagttctgtgatcatggctcactgcagcttcaccctgggttcaggtgatcctcccacttcagcctcttcagtaactgggactacagttctaggggcaccactatcagtt

SEQ ID NO: 152210 - DNA, 578 bp, Homo sapiens
  Payload ID: 9950
  Gene Symbol: MED21
  Gene Name: mediator complex subunit 21
  ENST ID: ENST00000536711
  CDS Start-End: 19-282
gtttgctgcggtaggaacatggcggatcggctcacgcagcttcaggacgctgtgaattcggtgaggaatttcattcgattagcctctgtctttctctttcttgaggtaaagcaagggaggaaaggggcccaagaggcaaaacttgaaagtggggagcggactgagagacagggcttcggcataaagcgctctctcgggaggcgccaccgcgaactcggaggtttgaggccggctgccgggcggtgcttgaaggtgcgggagggagcagactctttcgcttgaggagaccgggaagatcgttcttgtccggcttgcagatcagttttgtaatgccattggagtattgcagcaatgtggtcctcctgcctctttcaataatattcagacagcaattaacaaagaccagccagctaaccctacagaagagtatgcccagctttttgcagcactgattgcacgaacagcaaaagacattgatgttttgatagattccttacccagtgaagaatctacagctgctttacaggctgctagcttgtataagctagaagaagaaaaccatgaagctgctacatgtc

SEQ ID NO: 152211 - DNA, 1437 bp, Homo sapiens
  Payload ID: 9951
  Gene Symbol: MED22
  Gene Name: mediator complex subunit 22
  Uniprot ID: Q15528
  ENST ID: ENST00000343730
  CDS Start-End: 235-837
aaaaatcgaggcggggccgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcggccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccgccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgca

SEQ ID NO: 152212 - DNA, 987 bp, Homo sapiens
  Payload ID: 9951
  Gene Symbol: MED22
  Gene Name: mediator complex subunit 22
  ENST ID: ENST00000371999
  CDS Start-End: 215-619
aaaaatcgaggcggggccgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtcccaggtctccccgctgcgctgcttgaggctcggccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccagggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttaccttctgaatccatatgtagagatt

SEQ ID NO: 152213 - DNA, 560 bp, Homo sapiens
  Payload ID: 9951
  Gene Symbol: MED22
  Gene Name: mediator complex subunit 22
  ENST ID: ENST00000446777
  CDS Start-End: 148-560
gtgggagagacgcgggaaagtgcgggtcgcagaggcacttgaccaccccgccctaggccgacccggcggacgcggcgtctggtgtgcgggcgctggggcgggtatgagggtcccaggtctccccgctgcgctgcttgaggctcggccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccag

SEQ ID NO: 152214 - DNA, 561 bp, Homo sapiens
  Payload ID: 9951
  Gene Symbol: MED22
  Gene Name: mediator complex subunit 22
  ENST ID: ENST00000457204
  CDS Start-End: 229-561
attcctataaagctaaaaatcgaggcggggccgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtcccaggtctccccgctgcgctgcttgaggctcggccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggag

SEQ ID NO: 152215 - DNA, 532 bp, Homo sapiens
  Payload ID: 9951
  Gene Symbol: MED22
  Gene Name: mediator complex subunit 22
  ENST ID: ENST00000494177
  CDS Start-End: 128-532
aaagctaaaaatcgaggcggggccgagaggctgcggcggctgactaggttttcggaccgcggcgcggcggggaagagagactgcggcgggtcccaggtctccccgctgcgctgcttgaggctcggccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattac

SEQ ID NO: 152216 - DNA, 3867 bp, Homo sapiens
  Payload ID: 9951
  Gene Symbol: MED22
  Gene Name: mediator complex subunit 22
  Uniprot ID: Q15528
  ENST ID: ENST00000610888
  CDS Start-End: 235-657
aaaaatcgaggcggggccgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcggccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccagggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttaccttctgaatccatatgtagagatttcagccaaggctgggccagccttttttgggcagtcaggtccacacctatgtccagggcaccagggatgcaattccatgtggatgtcaccaaaccccagtgtggaggcagggacagtcatgggaatgtgggggatgaagcccaggcagggaatggccttgaaagccattggagctccaattcgtgacccactcagccttatccacggagctggagccaacctacgtgccaggccccgtgctgggtcccagggatgcagaagggtcaaaacccatcatcctgacccttgtggggctccgtaagaagctgaaaccttcgaccgtttgagctggaggggccctgagaaatcagagtctacgtatcatttacttagggggaaacttaggctggagacagggaggccttccactctgccccattagcttagaaaatcaagattcagtccagcagatgcagagtccatgtccatcttgtgccttctcctggacaaacctttccttcctggtggtggatttaaaatactcctttctgcccattggccatgctgggagccacagatatccagagccagcatgacctggggcttggtttccctgccctgggctcagtggcactgctgagctgcagcagtcctagagttttccagggggttctgagggaatctttggtccccagtactcattaactcagcagacatgaggcagcatttcctccacactagggtggctgagaggggtcctggggtgtttcagacccttctgggcatctccttccacagctgttcagtttgtcggtctctttgaggcagccaccgtccctgagggcccctgcacagagcagctgtgggcctgtaattcagcctgcctgccttgccttggggcagggagagagggaacctgctcacggccctgcagcagagcagggcgcaaacccaggacatctgtgccaggcttcccatgccctcccccaacagtccctcagcttcacccagcggggcttccaggccagcctgtgtcccctcccgcaggcctcctgtccacaccagcgccccctggggggcctcacacagcccctgtggcagaagcagttgccctcctctgtacattgcctttaagcgaccaggtcctggccgagtttcctctgccccttcttgctggtcccccaaagggcgctccgctccctgccctgccctgccctgttccgcatgagctgcgcctctgtgctcgcctgccccctctctgcttgttagttgctctttctggctctgcctctcctttgcgttcctcgggatgccactctgtgcccaggacggttctgagactgaacactgagggcaggagcaagggaggaagccaggggcgaggcaggccgcgggaaagccagggcccctgcctgcaggttagaaagaggcgagcgtggattgtcacagctgcgggcatgggaagggctagctgagctcttcacctgcatcctggctgccgtgaggattccccgtgttagaggtggggacgcctgctggaggccgcctggctgatgtagggctatcgggaagtgccagggcctgtgttcccaactgtcgcccccttcaggctaagtctcaggcagggacagacccagaaagaacacagtctgccctcagagagctctttgcagtgtagtgacactggggtttctgcagtcagggaggagggagggtggccaggctgacagctttttgcaagaggagggggaccagcaccagctgggaggcataggctaggacaggcccacgtggaggctgggcaggaagggcctgctgaggtcacacagctgttggtggttgggccagggcggcttcctcctttcagaatgctagggtggctctcaccactggccgcctctccttgccaggcctgccaactcaggggacagatggagcaggagtggagaaagggaaaggcaggtctggggtgtggtcgtgttttcttaactctgcttctgtcttgctctcccctcccctggctttcctctctgcctgctcctgtctctccctggggtttctggtggtggaaaagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccgccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgca

SEQ ID NO: 152217 - DNA, 3886 bp, Homo sapiens
  Payload ID: 9951
  Gene Symbol: MED22
  Gene Name: mediator complex subunit 22
  Uniprot ID: Q15528
  ENST ID: ENST00000614493
  CDS Start-End: 255-677
acaaacaatgcgagtgcgtccaggagtccgctcggtcgtgcgccagactccgaacctagggggccccgggccctccctgagcaccgcgcgcaaaggcccggccccagggccaggcaactccagcgccgaggccgtccagtgcggctggagggcagaggccgagaggcgcggcgcggaacttgagccccttgtcccggcgcaccggggaaccatgaggtcccaggtctccccgctgcgctgcttgaggctcggccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccagggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttaccttctgaatccatatgtagagatttcagccaaggctgggccagccttttttgggcagtcaggtccacacctatgtccagggcaccagggatgcaattccatgtggatgtcaccaaaccccagtgtggaggcagggacagtcatgggaatgtgggggatgaagcccaggcagggaatggccttgaaagccattggagctccaattcgtgacccactcagccttatccacggagctggagccaacctacgtgccaggccccgtgctgggtcccagggatgcagaagggtcaaaacccatcatcctgacccttgtggggctccgtaagaagctgaaaccttcgaccgtttgagctggaggggccctgagaaatcagagtctacgtatcatttacttagggggaaacttaggctggagacagggaggccttccactctgccccattagcttagaaaatcaagattcagtccagcagatgcagagtccatgtccatcttgtgccttctcctggacaaacctttccttcctggtggtggatttaaaatactcctttctgcccattggccatgctgggagccacagatatccagagccagcatgacctggggcttggtttccctgccctgggctcagtggcactgctgagctgcagcagtcctagagttttccagggggttctgagggaatctttggtccccagtactcattaactcagcagacatgaggcagcatttcctccacactagggtggctgagaggggtcctggggtgtttcagacccttctgggcatctccttccacagctgttcagtttgtcggtctctttgaggcagccaccgtccctgagggcccctgcacagagcagctgtgggcctgtaattcagcctgcctgccttgccttggggcagggagagagggaacctgctcacggccctgcagcagagcagggcgcaaacccaggacatctgtgccaggcttcccatgccctcccccaacagtccctcagcttcacccagcggggcttccaggccagcctgtgtcccctcccgcaggcctcctgtccacaccagcgccccctggggggcctcacacagcccctgtggcagaagcagttgccctcctctgtacattgcctttaagcgaccaggtcctggccgagtttcctctgccccttcttgctggtcccccaaagggcgctccgctccctgccctgccctgccctgttccgcatgagctgcgcctctgtgctcgcctgccccctctctgcttgttagttgctctttctggctctgcctctcctttgcgttcctcgggatgccactctgtgcccaggacggttctgagactgaacactgagggcaggagcaagggaggaagccaggggcgaggcaggccgcgggaaagccagggcccctgcctgcaggttagaaagaggcgagcgtggattgtcacagctgcgggcatgggaagggctagctgagctcttcacctgcatcctggctgccgtgaggattccccgtgttagaggtggggacgcctgctggaggccgcctggctgatgtagggctatcgggaagtgccagggcctgtgttcccaactgtcgcccccttcaggctaagtctcaggcagggacagacccagaaagaacacagtctgccctcagagagctctttgcagtgtagtgacactggggtttctgcagtcagggaggagggagggtggccaggctgacagctttttgcaagaggagggggaccagcaccagctgggaggcataggctaggacaggcccacgtggaggctgggcaggaagggcctgctgaggtcacacagctgttggtggttgggccagggcggcttcctcctttcagaatgctagggtggctctcaccactggccgcctctccttgccaggcctgccaactcaggggacagatggagcaggagtggagaaagggaaaggcaggtctggggtgtggtcgtgttttcttaactctgcttctgtcttgctctcccctcccctggctttcctctctgcctgctcctgtctctccctggggtttctggtggtggaaaagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccgccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgc

SEQ ID NO: 152218 - DNA, 4367 bp, Homo sapiens
  Payload ID: 9951
  Gene Symbol: MED22
  Gene Name: mediator complex subunit 22
  Uniprot ID: Q15528
  ENST ID: ENST00000610672
  CDS Start-End: 583-1185
ctgagcaccgcgcgcaaaggcccggccccagggccaggcaactccagcgccgaggccgtccagtgcggctggagggcagaggccgagaggcgcggcgcggaacttgagccccttgtcccggcgcaccggggaaccatgagggatgttaagcgagggagtggaattaccccccttttttttttcttttggagacgtagtctccccctgtcgcccaggctggagtgcagtggcgcgatctcggctcactgcgacctgtgcttcccgggttcaagcgattctcctgcctcagcctcccgagtagctgggattacaggcgcctgccatcacgcccggctaatttttgtatttttagtagagttggggtttcaccatgttggtcaggctagtctcaaactcctgacctcaggtgatccctgcctcggcctcccaaagtgctgggattacaggcgtgagccaccgcgcccggttggaatgaccactttttaggacctcttccctgccgcgcagagactggagggagcggggcccgcagtgcagggatgaggtcccaggtctccccgctgcgctgcttgaggctcggccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccgccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgcattgctgctctttcttcctcattccttgtcagtccaggaccatccttggtctcccagcagttgtccgagcagcagctcctcagctctgcctggacagcctggcccaaggtcactctctcctcattggcacctggtaggtccccagtattcagtgaatggacctgctgccatcattgcacatccaggcacctgtgcctctgctggcatctcatcctcactgctaccagagccggtgctcctagtgccggtattttagagaggagaggatgtggacttagaaggggtgaggtgtaccacggccacagagctaggaagtgaagtggcaggaatcagaacttgaacctgatggaagtctagacccagtgtcttttggtgccaggctcaccttagaaatgcagaagtcacaacactgggcaggaagtgtggggggagcacagttcgtccacaggaagtgtgggggagcaccccaccccagttcctccagcaccatccatgtgcttcatcttctcatgggggaggccatcatctttcccgatgtatgaatgaggtgacagcccaggatccagccttggggacaggtaagaacacagctgacccatcaccacctgaaccagagaaccccacagccaagcagaaggcaccagacagacaggagcttgaggcccagtcctggctctggacctggcttctggggtggcctagggaagttgcttcccctctgagggagaatttccccattgatacgtgtggtgatctgttcccgcactattttagctgtggaaatgccttgtacttaaccactgaggaagaaaaagattacaaccagatggaagcatatatgaagcgagagcccggaaggaactggccagactttgtggtgggatcccacttaccctgttcctaaaatcctgagcgataagacctgccatcagcttcattttctgcttggccaggaccatcattcccatgtgaaaatcaagttatttctccttcttaaagccaagccgctctgctgaccttttttcctctccagctcatggccttggcagcagagctccacggggaagcagctgataaccatttgcagttctctcttgggcctacgtcagacaggttttgtctccatgactctagcaaaactacacctattaaggtcaccagtggcctccacattgctaagccccggcccattctcagtccatgtaactcttttatcccaagctttttattttgagggcagtggaactcatggaagtacttgtcagtttgcctctctgagcacattctccttcgtccatcaccacaaccagaatggatgatgattgcatatcctctggtatctagctgtattcagatttcttcagttgttccccaaatagtttttttaatgcctattttttttctttctagtccagaggtcttttatttttttaacacccacgatgccatgaattcatagggaagaggttccagcagctcaggctccttcccattggttctcacagtgtgctgctctgggtggagcaggctggcgcttcagttgaatccaggtacctttctctttggcttccctctttttctgatcattttccttcacgcgtttcaggaagctctctcggctcttagagtgcttagtgtgctgaatatgcacattcattctcttggcaagaatcttgcccttacttgtttacaacagtgccaacagcatgctggggaacactgtagactctcccagtctagccatggtgacatttgtggggcattcctttttgaacagtacccattcccttgatatctacaatatcacctttctcatcaatttgcatatacttggccaaaggaacaactgcatgttttctgaaaggcctagagaacatatattgggtgcctctcctctttccctttgtgttcgtcattttggcgaattactggaaggtggcggttccagctgaaaggcttttatgcctgtttttattgtgtgttgcatttggttgttattttggagtcttaaaatctaaaacaggaccaggtcaggcccagtggctcctgctgtaatcccagcactttgagaagccaaagcgggtggatcacttgtggtcagaagttttgagaccagcctgggcaacatggagaaaccccgtctctactaaaaagtatagaaatcggccgggcgcggtggcttacgcctgcaaccccagcactttgggaggccaaggcgggcggatcacctgaggtcgggatttccagaccagcctgaccaacatggagaaaccctgtctctactaaaaagtatagaaattggccgggcgcggtggctcacgcctgtaatcccagcactttgggaggccgaggcgggcagatcacctgaggtcgggagttccagaccagcctgaccaacatggagaaaccctgtctctactaaaaatacaaaaattagccgggcgtgctggtccatgcctataatcccagctacttggtaggcggaggcaggagaatcgcttgaacccgggaggcggaggttgcagtgagccgagatcgggccactgcactccagcttgggcaacaagagcgaaactccacctc

SEQ ID NO: 152219 - DNA, 561 bp, Homo sapiens; identical to SEQ ID NO: 152214
  Payload ID: 9951
  Gene Symbol: MED22
  Gene Name: Mediator complex subunit 22
  ENST ID: ENST00000630604
  CDS Start-End: 229-561

SEQ ID NO: 152220 - DNA, 3867 bp, Homo sapiens; identical to SEQ ID NO: 152216
  Payload ID: 9951
  Gene Symbol: MED22
  Gene Name: Mediator complex subunit 22
  ENST ID: ENST00000626118
  CDS Start-End: 235-657

SEQ ID NO: 152221 - DNA, 4367 bp, Homo sapiens; identical to SEQ ID NO: 152218
  Payload ID: 9951
  Gene Symbol: MED22
  Gene Name: Mediator complex subunit 22
  ENST ID: ENST00000629522
  CDS Start-End: 583-1185

SEQ ID NO: 152222 - DNA, 532 bp, Homo sapiens; identical to SEQ ID NO: 152215
  Payload ID: 9951
  Gene Symbol: MED22
  Gene Name: Mediator complex subunit 22
  ENST ID: ENST00000629994
  CDS Start-End: 128-532

SEQ ID NO: 152223 - DNA, 3886 bp, Homo sapiens; identical to SEQ ID NO: 152217
  Payload ID: 9951
  Gene Symbol: MED22
  Gene Name: Mediator complex subunit 22
  ENST ID: ENST00000629975
  CDS Start-End: 255-677

SEQ ID NO: 152224 - DNA, 987 bp, Homo sapiens; identical to SEQ ID NO: 152212
  Payload ID: 9951
  Gene Symbol: MED22
  Gene Name: Mediator complex subunit 22
  ENST ID: ENST00000629701
  CDS Start-End: 215-619

SEQ ID NO: 152225 - DNA, 560 bp, Homo sapiens; identical to SEQ ID NO: 152213
  Payload ID: 9951
  Gene Symbol: MED22
  Gene Name: Mediator complex subunit 22
  ENST ID: ENST00000629491
  CDS Start-End: 148-560

SEQ ID NO: 152226 - DNA, 1437 bp, Homo sapiens; identical to SEQ ID NO: 152211
  Payload ID: 9951
  Gene Symbol: MED22
  Gene Name: Mediator complex subunit 22
  ENST ID: ENST00000631196
  CDS Start-End: 235-837

SEQ ID NO: 152227 - DNA, 4581 bp, Homo sapiens
  Payload ID: 9952
  Gene Symbol: MED23
  Gene Name: mediator complex subunit 23
  Uniprot ID: Q9ULK4
  ENST ID: ENST00000354577
  CDS Start-End: 157-4254
gagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagaccttgaacattgctcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcagtaaaaagtcagagtacacagcaagggttccaaattaagaggaagcaaaacgctgcccagatcctgagaaacctggagaaaatcaaccttagtagtttcaactcatacattgtcttgtttgattttgttctttgttttttatcctctttaagcacagatgcgtgttgaagtctaaggtgttctgtcatcacactctctttactagaataagtgtgcccaggcagaaaaaaaagtgtattcaatgttgctggcatgtgtggattcacagctcgtggctgtaaggaaatctgggggtttcataaatccattaaaatccttttagagttgccaa

SEQ ID NO: 152228 - DNA, 2811 bp, Homo sapiens
  Payload ID: 9952
  Gene Symbol: MED23
  Gene Name: mediator complex subunit 23
  Uniprot ID: Q9ULK4
  ENST ID: ENST00000368053
  CDS Start-End: 151-2811
acgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagaccttgaacattgctcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggtaagaataaatacatttctaagcttattctcttag

SEQ ID NO: 152229 - DNA, 4576 bp, Homo sapiens
  Payload ID: 9952
  Gene Symbol: MED23
  Gene Name: mediator complex subunit 23
  ENST ID: ENST00000368058
  CDS Start-End: 18-4142
cgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagaccttgaacattgctcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtaaagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtgaagccagactgtactgtggagaaagtagaaatatatccgtctttgagagtggactcaaaccttttaaatctgaatgcgatcacactgtagtgatatagtagaagcagtgatgatattcagattgttttattttgattcaaatgatgaatctgttgacaccttataactcccatctccctatctatatttttgtctctaagagatcaagtaagatacatgttgttcatattcataacaacttattagagctatgtaggaacatagaggtatctgtgatcaaatgacttgtcattggcactttcagtctttcctattctagccgttgtttttgtttgtattttttattattaatgacatatttagtcttcagatatattattttaaaggcaccacacatgtaaaacagttattacaaatattttatacataaatctc

SEQ ID NO: 152230 - DNA, 4446 bp, Homo sapiens
  Payload ID: 9952
  Gene Symbol: MED23
  Gene Name: mediator complex subunit 23
  Uniprot ID: Q9ULK4
  ENST ID: ENST00000368060
  CDS Start-End: 181-4275
gttcctgctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggttgacactctcacctgacagatgatgtaattcttcaatttttataatcttaaaatttttaaattttatatttgtaaatacagtacacattttatttcttggattttgagagacattgttaattttgggggaattggcattgcgaaagacttgaaaactaatgagtaaagtctgctgaatgaataaacc

SEQ ID NO: 152231 - DNA, 5233 bp, Homo sapiens
  Payload ID: 9952
  Gene Symbol: MED23
  Gene Name: mediator complex subunit 23
  Uniprot ID: Q9ULK4
  ENST ID: ENST00000368068
  CDS Start-End: 181-4287
gttcctgctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtgaagccagactgtactgtggagaaagtagaaatatatccgtctttgagagtggactcaaaccttttaaatctgaatgcgatcacactgtagtgatatagtagaagcagtgatgatattcagattgttttattttgattcaaatgatgaatctgttgacaccttataactcccatctccctatctatatttttgtctctaagagatcaagtaagatacatgttgttcatattcataacaacttattagagctatgtaggaacatagaggtatctgtgatcaaatgacttgtcattggcactttcagtctttcctattctagccgttgtttttgtttgtattttttattattaatgacatatttagtcttcagatatattattttaaaggcaccacacatgtaaaacagttattacaaatattttatacataaatctcttggtagattttcagaataatagagatttatatcaagaaaaggaatctagattttgttgcattgtaggagcaaacaaggcttcatattctttttaaaatgacttgaaattttattataaatttccatagtttctatcaaggtcaactggcagttttattacctttgctatggacttgaacttactgtataaaattagttggaagccatgtaagaaaataacatctgaaaattcttgaacttaaaatcatgcttaaatggttgattctccaatttctttttttaaaaataagttaattgcttttgcaggttgacactctcacctgacagatgatgtaattcttcaatttttataatcttaaaatttttaaattttatatttgtaaatacagtacacattttatttcttggattttgagagacattgttaattttgggggaattggcattgcgaaagacttgaaaactaatgagtaaagtctgctgaatgaataaaccgtgtgattgtttcccg

SEQ ID NO: 152232 - DNA, 1636 bp, Homo sapiens
  Payload ID: 9952
  Gene Symbol: MED23
  Gene Name: mediator complex subunit 23
  Uniprot ID: Q9ULK4
  ENST ID: ENST00000539158
  CDS Start-End: 12-1439
tgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatc

SEQ ID NO: 152233 - DNA, 3446 bp, Homo sapiens
  Payload ID: 9953
  Gene Symbol: MED24
  Gene Name: mediator complex subunit 24
  Uniprot ID: O75448
  ENST ID: ENST00000356271
  CDS Start-End: 85-3015
acaagtgccaaaatggcgatgcctaccacctagaactggattgtgcgctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggctccctttgtg

SEQ ID NO: 152234 - DNA, 3896 bp, Homo sapiens
  Payload ID: 9953
  Gene Symbol: MED24
  Gene Name: mediator complex subunit 24
  ENST ID: ENST00000394126
  CDS Start-End: 420-3464
ggtgcgatctcggctcaccccaacaacctccgcctcccgggttcaagcgattctactgcctcagcctcccgagtagctgggattacaggcatgcaccaccaagcccggctaattttgtatttttagtggagacgaggtttctccatgttggtcaggctagtctcgaactcctgacctccggtgattcgcccgcctctgcctcccgaagtgctgggattacaggtgcgagccactgcgctcggccgatactttcttagtgccccagtttaaggaagggcggttcaggaggagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggctccctttgtga

SEQ ID NO: 152235 - DNA, 3456 bp, Homo sapiens
  Payload ID: 9953
  Gene Symbol: MED24
  Gene Name: mediator complex subunit 24
  Uniprot ID: O75448
  ENST ID: ENST00000394127
  CDS Start-End: 105-3035
aagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggc

SEQ ID NO: 152236 - DNA, 3479 bp, Homo sapiens
  Payload ID: 9953
  Gene Symbol: MED24
  Gene Name: mediator complex subunit 24
  Uniprot ID: O75448
  ENST ID: ENST00000394128
  CDS Start-End: 83-3052
aagtgccaaaatggcgatgcctaccacctagaactggattgtgcgctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggctccctt

SEQ ID NO: 152237 - DNA, 1105 bp, Homo sapiens
  Payload ID: 9953
  Gene Symbol: MED24
  Gene Name: mediator complex subunit 24
  ENST ID: ENST00000428757
  CDS Start-End: 201-1105
caggtgcgagccactgcgctcggccgatactttcttagtgccccagtttaaggaagggcggttcaggaggagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgctt

SEQ ID NO: 152238 - DNA, 905 bp, Homo sapiens
  Payload ID: 9953
  Gene Symbol: MED24
  Gene Name: mediator complex subunit 24
  ENST ID: ENST00000422942
  CDS Start-End: 1-879
gtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccaggtcttctctgggctctccatgtaccagttacctccgatgggtgaaggtcgggttggggcatccccggggagcaccacttttgcactcggcaggctgtttcccagcgctccatctgctccgtcccacagcagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtggggg

SEQ ID NO: 152239 - DNA, 957 bp, Homo sapiens
  Payload ID: 9953
  Gene Symbol: MED24
  Gene Name: mediator complex subunit 24
  ENST ID: ENST00000491466
  CDS Start-End: 1-253
gggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggtcccaccttctcccagagtgtgacctcacccactctcatggaactccctcctgtcactctccccccactctctacagccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaat

SEQ ID NO: 152240 - DNA, 628 bp, Homo sapiens
  Payload ID: 9953
  Gene Symbol: MED24
  Gene Name: mediator complex subunit 24
  ENST ID: ENST00000543759
  CDS Start-End: 60-628
ttcttgacaagtgccaaaatggcgatgcctaccacctagaactggattgtgcgaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgct

SEQ ID NO: 152241 - DNA, 548 bp, Homo sapiens
  Payload ID: 9953
  Gene Symbol: MED24
  Gene Name: mediator complex subunit 24
  ENST ID: ENST00000537674
  CDS Start-End: 60-548
ttcttgacaagtgccaaaatggcgatgcctaccacctagaactggattgtgcgaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctct

SEQ ID NO: 152242 - DNA, 3334 bp, Homo sapiens
  Payload ID: 9953
  Gene Symbol: MED24
  Gene Name: mediator complex subunit 24
  ENST ID: ENST00000535508
  CDS Start-End: 83-385
aagtgccaaaatggcgatgcctaccacctagaactggattgtgcgctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttg

SEQ ID NO: 152243 - DNA, 3037 bp, Homo sapiens
  Payload ID: 9953
  Gene Symbol: MED24
  Gene Name: mediator complex subunit 24
  ENST ID: ENST00000501516
  CDS Start-End: 11-3037
gagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcattgcacacatcccagggacttgggcagggtggcacccgagccaatcaaccaacagcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctga

SEQ ID NO: 152244 - DNA, 2441 bp, Homo sapiens
  Payload ID: 9953
  Gene Symbol: MED24
  Gene Name: mediator complex subunit 24
  ENST ID: ENST00000535071
  CDS Start-End: 69-2441
gacaagtgccaaaatggcgatgcctaccacctagaactggattgtgcgatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgag

SEQ ID NO: 152245 - DNA, 592 bp, Homo sapiens
  Payload ID: 9953
  Gene Symbol: MED24
  Gene Name: mediator complex subunit 24
  ENST ID: ENST00000582023
  CDS Start-End: 64-592
agttgacagcttctctccaagagaggcagtttgggctctgaggtatgcgacaggggctccaggatgatccaggaatggctccaggtggagggccttaggctgtggctacaggcacagaatgacagcaggggagcaggcaaagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggc

SEQ ID NO: 152246 - DNA, 597 bp, Homo sapiens
  Payload ID: 9953
  Gene Symbol: MED24
  Gene Name: mediator complex subunit 24
  ENST ID: ENST00000585306
  CDS Start-End: 120-597
gtctgccagtcgatgccacctcctcggtgatcaggtttggccggaaccctggggagcaaggctgcagtatgtagtgctcaggctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgcca

SEQ ID NO: 152247 - DNA, 957 bp, Homo sapiens
  Payload ID: 9953
  Gene Symbol: MED24
  Gene Name: mediator complex subunit 24
  ENST ID: ENST00000580008
  CDS Start-End: 1-417
gccattagttcccagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcattgcacacatcccagggacttgggcagggtggcacccgagccaatcaaccaacagccactggattctggcctccctctgcctctctctcctgagcctgtgtgatgccataccttctgaagtcagctggctgtgtcccctggaaatcaggcttttgggaatggtctctggggtttccagctctaggtgcccaccccccttctggaaacagtgcatgctgccctcaggcccctccctccctgttgtcctcaggggaagccttcctgtgtggtttcgtgtgccggagggagtgccaaaatcgaggagttcagggccaggtgctccttctctcctgtttcccatcatgtttctgtacttccttccctctgccagcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcag

SEQ ID NO: 152248 - DNA, 580 bp, Homo sapiens
  Payload ID: 9953
  Gene Symbol: MED24
  Gene Name: mediator complex subunit 24
  ENST ID: ENST00000578161
  CDS Start-End: 152-580
agcttcttgacaagtgccaaaatggcgatgcctaccacctagaactggattgtgcgctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatc

SEQ ID NO: 152249 - DNA, 728 bp, Homo sapiens
  Payload ID: 9953
  Gene Symbol: MED24
  Gene Name: mediator complex subunit 24
  ENST ID: ENST00000578901
  CDS Start-End: 1-173
cgttactagagcaggccatgattggaccatcccccaatcctctcatcttgtcctacctgaagtatgccattagttcccagatggtgtcctactcttctgtcctcacagccatcaattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcg

SEQ ID NO: 152250 - DNA, 567 bp, Homo sapiens
  Payload ID: 9953
  Gene Symbol: MED24
  Gene Name: mediator complex subunit 24
  ENST ID: ENST00000580517
  CDS Start-End: 152-567
agcttcttgacaagtgccaaaatggcgatgcctaccacctagaactggattgtgcgctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagtttgatgacttttctcgggacctgtgtgtccaggcattgctggacatcatggacatgttttgtgaccgtctgagctgtcacggcaaagcagaggaatgcatcggactgtgccgagcccttcttagcgc

SEQ ID NO: 152251 - DNA, 524 bp, Homo sapiens
  Payload ID: 9953
  Gene Symbol: MED24
  Gene Name: mediator complex subunit 24
  ENST ID: ENST00000581058
  CDS Start-End: 1-70
tttgaatgaattcacaacctatggcagcgaagaaagcagtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgc

SEQ ID NO: 152252 - DNA, 1963 bp, Homo sapiens
  Payload ID: 9953
  Gene Symbol: MED24
  Gene Name: mediator complex subunit 24
  ENST ID: ENST00000580885
  CDS Start-End: 49-1963
gacaagtgccaaaatggcgatgcctaccacctagaactggattgtgcgatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagtgttcttcaggacttgatttcctgtcctgtccccagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctact

SEQ ID NO: 152253 - DNA, 604 bp, Homo sapiens
  Payload ID: 9953
  Gene Symbol: MED24
  Gene Name: mediator complex subunit 24
  ENST ID: ENST00000580302
  CDS Start-End: 442-604
acctactaactaggggctaacgaatgaaagggtgtcggaatatgatggagaagcccggtcgacagtgacgtcgtgggcgacgccgggttgtgagcggcctttcgagctccctcgagtccctgagtctctgtagtgcctcagctcctggatgtcctcccttaaaggagaagaacaatgcgggccgactagacgagtcccttagtttcctcgccggcgcagacaaatacggtttcagtccaaggaactaccattcccagaagacagcggggcgttccttgctgcatttctattggttggcgtttgttactcccagccaatagaaagtgagcttcttgacaagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccat

SEQ ID NO: 152254 - DNA, 454 bp, Homo sapiens
  Payload ID: 9953
  Gene Symbol: MED24
  Gene Name: mediator complex subunit 24
  ENST ID: ENST00000614384
  CDS Start-End: 18-431
ctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgt

SEQ ID NO: 152255 - DNA, 2332 bp, Homo sapiens
  Payload ID: 9954
  Gene Symbol: MED25
  Gene Name: mediator complex subunit 25
  Uniprot ID: Q71SY5
  ENST ID: ENST00000312865
  CDS Start-End: 54-2297
attccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtcagatgctgctgagcgggggtccccggggcccggtcccccagccgggcctgcagcccagcgtcatggaggacgacatcctcatggatctcatctgaatccccaacacccaataaagttcctttttaacaca

SEQ ID NO: 152256 - DNA, 1623 bp, Homo sapiens
  Payload ID: 9954
  Gene Symbol: MED25
  Gene Name: mediator complex subunit 25
  Uniprot ID: Q71SY5
  ENST ID: ENST00000538643
  CDS Start-End: 1-1605
atggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagacgttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtcagatgctgctgagcgggggtccccggggcccggtcccccagccgggcctgcagcccagcgtcatggaggacgacatcctcatggatctcatctgaatccccaacacccaataa

SEQ ID NO: 152257 - DNA, 760 bp, Homo sapiens
  Payload ID: 9954
  Gene Symbol: MED25
  Gene Name: mediator complex subunit 25
  ENST ID: ENST00000595185
  CDS Start-End: 1-760
atggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgccgggcctgcagcccagcgtcatggaggacgacatcctcatggatctcatctgaatccccaacacccaataa

SEQ ID NO: 152258 - DNA, 829 bp, Homo sapiens
  Payload ID: 9954
  Gene Symbol: MED25
  Gene Name: mediator complex subunit 25
  ENST ID: ENST00000593767
  CDS Start-End: 1-746
aagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccagcggcaaaacgaaagagagaaggagagggccgtgtgtttcgagaaaaatgggagcgagcctatttctttgtggaagtgaagagcatgcctatgtgtttaatatgcaaacaaatcgtgtctgtgttgaaagaatacaacctgaaacgccactatgaatcaaagcatagtaagagctacgaccagtacacagaacagactcgagatgccatcctcaacgaactgaaaaagggactcaaat

SEQ ID NO: 152259 - DNA, 642 bp, Homo sapiens
  Payload ID: 9954
  Gene Symbol: MED25
  Gene Name: mediator complex subunit 25
  ENST ID: ENST00000622402
  CDS Start-End: 64-606
atttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtcagatgctgctgagcgggggtccccggggcccggtcccccagccgggcctgcagcccagcgtcatggaggacgacatcctcatggatctcatctgaatccccaacacccaataaagttcctttttaacacac

SEQ ID NO: 152260 - DNA, 881 bp, Homo sapiens
  Payload ID: 9954
  Gene Symbol: MED25
  Gene Name: mediator complex subunit 25
  ENST ID: ENST00000612791
  CDS Start-End: 1-780
atggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccaggtcagatgctgctgagcgggggtccccggggcccggtcccccagccgggcctgcagcccagcgtcatggaggacgacatcctcatggatctcatctgaatccccaacacccaataa

SEQ ID NO: 152261 - DNA, 1467 bp, Homo sapiens
  Payload ID: 9954
  Gene Symbol: MED25
  Gene Name: mediator complex subunit 25
  ENST ID: ENST00000618715
  CDS Start-End: 1-1449
atggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgcccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtcagatgctgctgagcgggggtccccggggcccggtcccccagccgggcctgcagcccagcgtcatggaggacgacatcctcatggatctcatctgaatccccaacacccaataa

SEQ ID NO: 152262 - DNA, 801 bp, Homo sapiens
  Payload ID: 9954
  Gene Symbol: MED25
  Gene Name: mediator complex subunit 25
  ENST ID: ENST00000612854
  CDS Start-End: 64-765
atttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccagcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtcagatgctgctgagcgggggtccccggggcccggtcccccagccgggcctgcagcccagcgtcatggaggacgacatcctcatggatctcatctgaatccccaacacccaataaagttcctttttaacacac

SEQ ID NO: 152263 - DNA, 1293 bp, Homo sapiens
  Payload ID: 9954
  Gene Symbol: MED25
  Gene Name: mediator complex subunit 25
  ENST ID: ENST00000620467
  CDS Start-End: 64-1257
atttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgctgagacggacttcgggggagactatggggggacccagtacagcctcgtggtgttcaacacagtggactgcgctcccgagtcctacgtacaatgtcacgctcccaccagcagcgcctatgagtttgtcacctggctcgatggcattaagttcatgggcgggggtggtgagagctgcagcctcatcgcggaaggactcagcacagccttgcagctgtttgatgacttcaagaagatgcgcgagcagattggccagacgcaccgggtctgcctcctcatctgcaactcacccccatacttgttgcctgctgttgagagcaccacgtactctggatgcacaactgagaatcttgtgcagcagattggggagcgggggatccacttctccattgtgtctccccggaagctgcctgcgcttcggcttctgtttgagaaggcagcccccccggccttgctggagccgctgcagcctccgacagatgtgagccaggacccgaggcacatggtgctggttcggggactcgtgctgcctgttgggggtggctcagccccaggccccctccagtcaaagcagccagtccccctgcctcccgccgcaccctcaggtgccactctctcagcagccccccagcagcctctgccccccgtccccccgcagtaccaggttcccgggaacctgagtgcagctcaggtggccgcgcagaatgcagtggaggctgccaagaaccagaaggctgggctgggccctcgcttctcgcccatcacccctctccaacaagctgctcccggagtgggtccccccttcagccaggccccagctcctgcgctgctgcctccgccgcaccagggcctggggcagccccagttggggcccccactcctgcatccaccacctgcccagtcctggcccgcacaacttccccctcgggctccactgccaggtcagatgctgctgagcgggggtccccggggcccggtcccccagccgggcctgcagcccagcgtcatggaggacgacatcctcatggatctcatctgaatccccaacacccaataaagttcctttttaacacac

SEQ ID NO: 152264 - DNA, 3332 bp, Homo sapiens
  Payload ID: 9954
  Gene Symbol: MED25
  Gene Name: mediator complex subunit 25
  ENST ID: ENST00000622046
  CDS Start-End: 2154-2906
ggtggcatcgctccagggtcttcctccatcccgcagctgtcttccctctgtgtgtgtctccacatggcattctctctgtatctttgtgtctgtgcttataaggacatcagtaattttggattaggccccattttcctgacctcatcttactacaattgcaaagaccctctttccagatagagtcaccttcacaggtgctggggactggaacctcagcttagctttctggttttgttttttgagacagagtttcactgttgtcagccaggctggagtgcagtggtgcaatcttggctcacagcaacttccgtctcctgggttcaagcgattctcctgcctcagcctcccaagtagctgggattacaggcatgtgccactatgcccagctaatttctgtattttttagtagagacagggtttcaccatgttggccaggttggtctcgaacttctgacctcaagtgatctgcctgcctcggcctcccaaagtgctaggattaccggtgtgagccaccgcgcccagcctcagcatagctttctgggagtcacagttcacactttgtaactcggggaaggagcagatcagttacttccgtgcaccaggcactcctgcaggaaagagaaccttagggggatcacctcacgagaccctcacagaaccttgtgaagaaggcattcctgagagttagtacttccggctgcaaatcacgtagtttcccaaacacatagataattgggggcactcggaaaaaatgttctcttatgattctgtgggtcacctgggctcagtgggccatctcgcttggcgactctcacggggttgccatcagatggcagctgagactctggtcatctgaaacctttactgggctggatgttcaaaacagctcctcacacagccctggctgttggctggggcttggctaggaccggccatcccagtgtctgcacatggcctgtccacgtggccacactgtggcagctgggttctgagagggcaggcgttgtaggagcaggcatttatattttgcacaggacaggacatctagagggggccagctattgggattggtttcataggtctgtgacatcagggacagggccctgtggttctcttggcctctcctttatagtcacaaggtagctctcatggctccacgcatcctgtgtgctttcatgaaggaggggaagggggctgtgtgtttccctttcttcaagacagcagaaactttctcagattccagagcaggcattcctttcacctcctatcccggacctaggccactgggcagcccctagttgatgggaggctgctgggagcaggtatccgtgactgtctggggctgggacatgttacagccccagacagcattgggaatgcaggggaggaggacacttggatatggaataggcagctagcagggtctgtctcaggcaggaaaccgaggctcagagaagtcaattcacttggccaaggtcagcctcgcctccctcaggagcccctgccctgaatgctccatgtgttacccccctgatgaccagtgatgtttcctgggtgcttcctgtgggctgagcctcaggcagggctcttgctgtggatcagacatcgcatagtcacagcgaccctgtgatgtgggagcactccccgtggtgtacactggccggtgctgagggctggaggatctcttggatacccggggtccgacccaccgttgatcacaggcctgtgggtaccacgctgtgcatctaggccgctctcccggccgtgaccctcagccgccctctgaggaggccgccgtggcattttatgcccaagaaactgggtccatgaggagcaggtggtggctgaaggttgaagagctgggctccagcactttctctccgctttccctctcagtgggcagctggaaccctagcttgccctgagcgcctcagtttctgtctccagagcaacccatagcacacctgttctccttaaccttctatagcagaaacctcacctcaccttgcctgtggggcctctagagccttctggaatggggagggggtcagggctgcctctttcagggcctgaatggttctgaagagctgttgtccacccaggcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatcttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgccagggcctggggcagccccagttggggccccactcctgcatccaccacctgcccagtcctggcccgcacaacttccccctcgggctccactgccaggtaaggggacccgggggagggcagaggtctggactgagtgtcccagcagctcctgggctagagcaccaagaccgagtgctcctgggaagtaaagacataggatccaagaatgagggttcccccatggcctttgcggagctctgagggctccgggaaagtacagcccatgggtccaaggacctagtgggttaagagcgtttcccatgatcctcctgtgtgtgctcctgggattgctgggaaatgtggtcttagggccagagaagtagttttggagaagggcccccaaaggctcatgggaaacagcatatttgtaactagatggggccagaaggtgcttctgttgggtcccccaagggctgcctagaaaacttagtgcctctgggccctcctgggcccaagggcctactgggagatgcagtcccttccccactgcccctcaggtcagatgctgctgagcgggggtccccggggcccggtcccccagccgggcctgcagcccagcgtcatggaggacgacatcctcatggatctcatctgaatccccaacacccaataaagttcctttttaac

SEQ ID NO: 152265 - DNA, 1548 bp, Homo sapiens
  Payload ID: 9954
  Gene Symbol: MED25
  Gene Name: mediator complex subunit 25
  ENST ID: ENST00000617849
  CDS Start-End: 64-1512
atttctgctcattccgcggcgtcggctgcggctgcagtggtggtggcgggtaccgcacggggtatggtccccgggtccgagggcccggcccgcgccgggagcgtggtggccgacgtggtgtttgtgattgagggtacggccaacctgggaccctacttcgaggggctccgcaagcactacctgctcccggccatcgagtattttaatggtggtcctcctgcccccttcagccaggccccagctccccaactacccccaggaccccctggcgcccccaagccaccacctgcttcccagcccagtctggtctccactgtggcccctggctccggcctggctcccacggcacagcccggggcaccgtccatggcaggcactgtggccccaggaggggtgagcggcccttccccagcccagctgggagccccagccctcggtgggcagcagtcagtctccaataagcttctggcctggagcggggtcctggagtggcaagagaaacccaaacctgcctcagtggatgccaacaccaagctgacgcggtcactgccctgccaggtctacgtgaatcatggcgagaacctgaagacggagcagtggccccagaagctgatcatgcagctcatcccccagcagctgctgaccaccctgggccctttgttccggaactcaaggatggtccagttccatttcaccaacaaggacctggagtctctcaaaggcctctaccgcatcatgggcaacggcttcgcgggctgcgtgcacttcccccacacggcgccctgtgaggtgcgcgtgctcatgctcctgtactcgtccaagaagaagatcttcatgggcctcatcccctacgaccagagcggcttcgtcaacggcatccggcaggtcatcaccaaccacaagcaggtccagcagcagaagctggagcagcagcagcgaggaatggggggacagcaggcacccccagggctggggcccattctggaggaccaagccaggccctcacagaatctgctccagctccgcccaccgcagccccagcctcagggtaccgtaggggcctctggggccacggggcagccccagccccaaggtactgcccagcccccgccaggtgcccctcaaggccctcctggagcagcttctggcccaccccctcctggacccatccttcggccccagaaccctggggccaaccctcagctgcgaagcctcctcctcaacccaccaccgccgcagactggggtgcccccaccccaggcctccctccaccacctccagccaccaggggctcctgcgctgctgcctccgccgcaccagggcctggggcagccccagttggggcccccactcctgcatccaccacctgcccagtcctggcccgcacaacttccccctcgggctccactgccaggtcagatgctgctgagcgggggtccccggggcccggtcccccagccgggcctgcagcccagcgtcatggaggacgacatcctcatggatctcatctgaatccccaacacccaataaagttcctttttaacacac

SEQ ID NO: 152266 - DNA, 3174 bp, Homo sapiens
  Payload ID: 9955
  Gene Symbol: MED26
  Gene Name: mediator complex subunit 26
  Uniprot ID: O95402
  ENST ID: ENST00000263390
  CDS Start-End: 264-2066
tcactggagtttggttctcgaggcggcggcagcgagcggcggcggctccggcggctcctcctcctcctttggtggcggcggcggcccgggaccgagacccggccccggctcccctctccgccaccccgcgcgcccccaaccccccggcgccgcggggaacatgcggctccggctcccggaggccggcgagtgagtgacccccgtcccccgcctcagcccgcccgcccgctggcccggccgcaaccccccgcctcgcccaggcaatgacagcggctccggcgtctccgcagcagatcagggaccggctgctgcaggccatcgacccccagagcaacatccggaacatggtggcggtgctggaagtcatctccagcctggagaaataccctattaccaaagaggcacttgaggaaacacgacttgggaagctcatcaacgacgtccgcaagaaaaccaagaacgaggagctcgccaagcgggccaagaagctgctgcggagctggcagaagctcatcgagccggcacaccagcatgaggcggcgctgcgggggctggcgggggccaccggctctgccaacgggggcgcacacaactgccggccggaggtgggggcggctggcccacccaggagcatccatgacctgaagagccgcaatgacctccagaggctgcccgggcagcggctggacaggctgggcagccgcaagcgccggggtgaccagcgtgacctcggccacccagggccgccacccaaggtctccaaagctagccacgaccccctggtccccaactcatcccccctccccaccaacgggatcagtgggagtccagagagcttcgccagctccctggatggcagtgggcatgcaggcccagagggcagccgcctggagcgtgacgagaatgacaagcacagtggcaagatccccgtcaacgccgtgcgaccgcacaccagctccccgggcctgggcaagccccctggaccctgcttgcagccaaaggcttcggtgctgcagcagctggacagggtggacgagactccggggcctccccatcccaagggaccccctcgctgctctttcagtcctcggaactcacggcatgagggctcctttgcccggcagcagagcttgtatgcacccaagggctccgtgcccagcccctcaccgcggccccaggcactcgatgccacacaggtgccgtcaccgcttccactggcacagccgtccacaccccccgtacggcggctcgagctgctgcccagtgcggaaagcccagtgtgctggcttgagcagcctgagagccaccagcggctggcggggccgggctgcaaggcagggctgtccccagccgagcccctcctgtcccgggcaggcttttccccagactcctccaaggcggacagtgatgctgcctcctcagggggctcggacagtaaaaagaagaagaggtaccgacctcgagactatacggttaacttggacgggcaggtggctgaggcgggcgtcaagcctgtccggttaaaagagcggaagctcacctttgaccccatgacgagacagatcaaacctctgacccagaaagagccagtgcgggcagacagccctgtgcacatggagcagcagtccaggacagagctggacaagcaggaggccaaggccagcctccagagccccttcgaacagacgaactggaaggagctgtcacgcaacgagatcatccagtcctacctgagccggcagagcagcctgctctcatcatcgggcgcgcagaccccaggggctcaccacttcatgtctgagtacctgaagcaggaggagagcacccggcaaggggccaggcagctgcatgtgctggtgcctcaaagcccgcccacggacctccctggtctgacccgggaggtcacacaggacgatctcgacagaatccaggccagccagtggccgggggtgaacgggtgtcaggacacacagggtaactggtatgactggacgcagtgcatatcgctcgatccgcacggcgacgacgggcgcttgaacattctgccttatgtctgcttggactgaccggcctgtcagccacaaagtgcattcccatcttgcagaagccgggtgggcgggcaggcaggtgggcaggtggccggggcccagctgcctcctgcgctgggaactcggggagtccggcccaggcgggagggagggggcgggagtcacgcggtctctctgcgctcttccctcaaaactctttttgtgaaatgctgctaccagtttactaacaaaattgcgaagaaggaccgcgtggaaggaaggacggcaaagtgagttcagaactctatagcaaaccagctataaaaagcgttagtccctcacccccaaagaggtgcggacactttccagcacctgaaagctggggcctcagttgcaggcaggcacagaaaacctgtgggagaggtcacctttaacacagcaacagaagcacgcatctcatctctcttgcattttctgttctttaatttggccctgagtgtcttgagacagtgggccatgccactgcctctgtttgctccctacccagccactgtcaggccagtgttgtctgtcatgtgccagaagcttctcagctgtggtgagccactggcattgggcaggcgggccagctggccagccagtgtgacccacactccatgggcagccacctgtttatatctggtttcagttataacccagtttttaaagaaatgctgcaaaaatttaagttttctcatgtttattttaaacaattcctcttccatcagaccaccagacaaaaaaacctttcctttcttcctcccttttcttttttcccttcctgtacacatctagaaaacttcacctttctagagtccccccaaaacaacacaaaagttattgtgggtgctactggttttatgctgtactgtggggcgagggggaagacctgtctgtacgctggaaacactcataaccattcctttagattcgtttgccttatggttatttgtcataaacgcgatttgcaaaaacaaggagccttagtgaatgtacagtacctagacttctgtgttctcaggacgcagaagggagcaactttgctatttggtccagtaagtggacaccttgtgatataaatgtggaaataaaaaaaaaaaaaaaacca

SEQ ID NO: 152267 - DNA, 539 bp, Homo sapiens
  Payload ID: 9955
  Gene Symbol: MED26
  Gene Name: mediator complex subunit 26
  ENST ID: ENST00000598492
  CDS Start-End: 208-539
agacatgcaccttcccgtcattgttcctcccagtgtcattcttcctctgagaagctgtgaacttgaggctttgcccctggggtttgaggctcccatgaggtcccctcagaggaaggtgccttcactgggcagagcctggtggacctgcaccagccccatgaggctgagcggagagtgcagggtggggcccgcctgaggatccggaacatggtggcggtgctggaagtcatctccagcctggagaaataccctattaccaaagaggcacttgaggaaacacgacttgggaagctcatcaacgacgtccgcaagaaaaccaagaacgaggagctcgccaagcgggccaagaagctgctgcggagctggcagaagctcatcgagccggcacaccagcatgaggcggcgctgcgggggctggcgggggccaccggctctgccaacgggggcgcacacaactgccggccggaggtgggggcggctggcccacccaggagcatccatgacctgaagagccgcaatgacctccagaggctgcccgg

SEQ ID NO: 152268 - DNA, 742 bp, Homo sapiens
  Payload ID: 9955
  Gene Symbol: MED26
  Gene Name: mediator complex subunit 26
  ENST ID: ENST00000598608
  CDS Start-End: 104-742
atcacggggttctctgccggtgggggggcggggggactgtgcccccacaagggacggcggcaatgactgcagattgggggagggggcgcttcggaggccagagatgccgctcaacttccgacagatcgggggacccgccccgaagacagagcgatcccgcccaaatgccagtggtgccgaggtggagaagccgccgcgtagacgcagatttgcaacctccggctttcccagctacggcgggcggcttctgccagaggcgctttgccgcctcacgttttcgcgatcggggtcgcgcgtggcggtgcagacccccgccctgccaccacacccattcccacaccctctgaggggcgggggggccgcggcgacacccccggactccgatgacccttctgcgcgcagaatcacaacgtggacgtctggttccctcgccctcacaaaaaactcggcagctgctcagcctgcgactcccgtcccccagtcacgcgccgggaaggctctcccagaggaaggattttcccgccgccctccccgccccgagatccggaacatggtggcggtgctggaagtcatctccagcctggagaaataccctattaccaaagaggcacttgaggaaacacgacttgggaagctcatcaacgacgtccgcaagaaaaccaagaacgaggagctcgccaagcgggccaagaagctgctgcggagctggcagaagctcatcgagccggcacaccagcatgag

SEQ ID NO: 152269 - DNA, 558 bp, Homo sapiens
  Payload ID: 9955
  Gene Symbol: MED26
  Gene Name: mediator complex subunit 26
  ENST ID: ENST00000601478
  CDS Start-End: 395-558
agtagaactgtgaggaacacagatgttaagtgatgattaacaaacttagcttttagaggaaaggtccgacgaatagtagacggtgtactgcatcctcatggcaagtaaaataaccgcacagggcagggcttgctagctgcaggtgaatgccctgtgttcagaccagggagaggcctgagaaggtcccgcagcaaagagggacttgaactagccctggccgcgtgtgtcagtgcctccagctgccaggctctgagcgggaaacgtccttgggagctgctttctttttcacagctcttcaggcaacagagaccaagggagaggtgaccgaggcactctgcagagagacacagcaagaaagatcattttcccacctaagaattggaagatccggaacatggtggcggtgctggaagtcatctccagcctggagaaataccctattaccaaagaggcacttgaggaaacacgacttgggaagctcatcaacgacgtccgcaagaaaaccaagaacgaggagctcgccaagcgggccaagaagctgctgcggagctggcagaa

SEQ ID NO: 152270 - DNA, 478 bp, Homo sapiens
  Payload ID: 9955
  Gene Symbol: MED26
  Gene Name: mediator complex subunit 26
  ENST ID: ENST00000600060
  CDS Start-End: 231-478
gagcggcggcggctccggcggctcctcctcctcctttggtggcggcggcggcccgggaccgagacccggccccggctcccctctccgccaccccgcgcgcccccaaccccccggcgccgcggggaacatgcggctccggctcccggaggccggcgagtgagtgacccccgtcccccgcctcagcccgcccgcccgctggcccggccgcaaccccccgcctcgcccaggcaatgacagcggctccggcgtctccgcagcagatcagggaccggctgctgcaggccatcgacccccagagcaacatccggaacatggtggcggtgctggaagtcatctccagcctggagaaataccctattaccaaagaggcacttgaggtgagtatcccagaccccagcatttgggagggcagaacggggggcaggggatggtaccaaccaggtccttccgcagcttctgggagcatcagtgtctttgc

SEQ ID NO: 152271 - DNA, 1444 bp, Homo sapiens
  Payload ID: 9955
  Gene Symbol: MED26
  Gene Name: mediator complex subunit 26
  Uniprot ID: O95402
  ENST ID: ENST00000611692
  CDS Start-End: 1-279
atgacagcggctccggcgtctccgcagcagatcagggaccggctgctgcaggccatcgacccccagagcaacatccggaacatggtggcggtgctggaagtcatctccagcctggagaaataccctattaccaaagaggcacttgaggaaacacgacttgggaagctcatcaacgacgtccgcaagaaaaccaagaacgaggagctcgccaagcgggccaagaagctccctggatggcagtgggcatgcaggcccagagggcagccgcctggagcgtgacgagaatgacaagcacagtggcaagatccccgtcaacgccgtgcgaccgcacaccagctccccgggcctgggcaagccccctggaccctgcttgcagccaaaggcttcggtgctgcagcagctggacagggtggacgagactccggggcctccccatcccaagggaccccctcgctgctctttcagtcctcggaactcacggcatgagggctcctttgcccggcagcagagcttgtatgcacccaagggctccgtgcccagcccctcaccgcggccccaggcactcgatgccacacaggtgccgtcaccgcttccactggcacagccgtccacaccccccgtacggcggctcgagctgctgcccagtgcggaaagcccagtgtgctggcttgagcagcctgagagccaccagcggctggcggggccgggctgcaaggcagggctgtccccagccgagcccctcctgtcccgggcaggcttttccccagactcctccaaggcggacagtgatgctgcctcctcagggggctcggacagtaaaaagaagaagaggtaccgacctcgagactatacggttaacttggacgggcaggtggctgaggcgggcgtcaagcctgtccggttaaaagagcggaagctcacctttgaccccatgacgagacagatcaaacctctgacccagaaagagccagtgcgggcagacagccctgtgcacatggagcagcagtccaggacagagctggacaagcaggaggccaaggccagcctccagagccccttcgaacagacgaactggaaggagctgtcacgcaacgagatcatccagtcctacctgagccggcagagcagcctgctctcatcatcgggcgcgcagaccccaggggctcaccacttcatgtctgagtacctgaagcaggaggagagcacccggcaaggggccaggcagctgcatgtgctggtgcctcaaagcccgcccacggacctccctggtctgacccgggaggtcacacaggacgatctcgacagaatccaggccagccagtggccgggggtgaacgggtgtcaggacacacagggtaactggtatgactggacgcagtgcatatcgctcgatccgcacggcgacgacgggcgcttgaacattctgccttatgtctgcttggac

SEQ ID NO: 152272 - DNA, 1431 bp, Homo sapiens
  Payload ID: 9956
  Gene Symbol: MED27
  Gene Name: mediator complex subunit 27
  Uniprot ID: Q6P2C8
  ENST ID: ENST00000292035
  CDS Start-End: 65-1000
atcagcgagcgcggcttttttgcttgcgaagccggctttggagagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctggtgaccttgggaaaggtgttgaaagtgatcgtcgtcatgcggagcctgttcattgatcgaacaatagtaaagggatataacgagaatgtctacacagaagatggcaagcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctggataa

SEQ ID NO: 152273 - DNA, 1281 bp, Homo sapiens
  Payload ID: 9956
  Gene Symbol: MED27
  Gene Name: mediator complex subunit 27
  Uniprot ID: Q6P2C8
  ENST ID: ENST00000357028
  CDS Start-End: 23-850
gagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctgcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctggataa

SEQ ID NO: 152274 - DNA, 762 bp, Homo sapiens
  Payload ID: 9956
  Gene Symbol: MED27
  Gene Name: mediator complex subunit 27
  Uniprot ID: Q6P2C8
  ENST ID: ENST00000474263
  CDS Start-End: 23-415
gagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagaaagagcaactttctattccaagaatattccattggaaagtctgaagacatttcctccctcctgccctcctgaactgttcttattagaatccagttgcttaatgactaagttactgcaaagttcacctctcacatctatctctgaaggtgctcttttctgtttttgcatcatggaactaacagggttggaatcgttttacattgcaacgcagagcctttcctttagggactctgtcctctattaagggtaaactataaggctcaggggagaggcaccatgtccatcttgttccttgctgggagtccccagcaactagcaaggcgcctggtacactgtaatcattcagtgaagattcactgagagaatgaaagaataaatgaatcgaagcgtt

SEQ ID NO: 152275 - DNA, 10868 bp, Homo sapiens
  Payload ID: 9957
  Gene Symbol: MED28
  Gene Name: mediator complex subunit 28
  Uniprot ID: Q9H204
  ENST ID: ENST00000237380
  CDS Start-End: 25-561
gatctctcttgcgccattccaaacatggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgagcaaagggcagaggcagttggcctatgagtgggctgatgcgtgaggttggccacacattccttcctgtggacttgacattttggaagaactctttgccagataatgagttcattttagttttatgctcccattgaaaaattttccactatttttataagctgttaatttcttgagtactttataacatgtctgtagcttggataaaccaagtaagtattttttttttgtctttagcaaagtttagactgtgaatatgatgacacagattcttttttatggtggctttgcttgttttaaatttttgcatgacttttcatctttttatgtgtgtttcctgtagtttgatccgaaggaaaagagtatagtagcctgagaatcaggagatgggagttttagtcgtaggccttatgataattaccccgcggtggtgtgtagaaaagtatgtaaatttgctctgttttaagactttgaactacctcaagaagaggaatctaatacaatatttgtaatgtttccagagctctcagaatgaggatttttttgtaaataggtcagaagacgatggaactgtcctgggttagtatagtaatcttacagtaggatccttaggttgatgctgacttctgtttggggtatgtttatattttatgtggtgtttactttttttttttgacatagaaggatatagtgggagcagtgatacgctaacattcattacattctgcagtaatgaatctgtttaatgggtcagtcactgttttcagtagcatgacagtggggtcataggtgagctgtgaggggctaaatcttgctctgattgtctctttctgttttgagttttgtttgcgtgtatcatttttgttctacattttgggaggggaaacattttccgttaaggaaggttgttgccagtggatttgactccaagggactagagtgtcgtggtgggggtggggaggggctgcagggtgatcattggctactgagcctccacagagagcatgtggtgccctgcctttgggagggtattttgctctcgttagttttgtgggcagcctcagattccctgttgagttgctgttaagaaatggagatttctggctctcattgggtaaggttttctgagttttatatcttattagatcacatccctttacccagaacaaatgcttcactgtcttctgattggcagtactcctgtggctttgtgccttgactcattttgttgtcttcagccttgaaggccccttcccacatggactgacatccactcatgtgcctgatccctgaagcctcccagcacccattcagttgcatccccagggcacaggactttgatctcttctgttgccctcgctaggttctccctggtgggttagtgctttgtatctgtctctctgcccctcactaattctacacccatgagaattagacattattctccttaaatatataaggaccatataatctgtatctttttggtgtgtgtatatggtatctggcacatggatctctgattaccagcctgacatcaacaaatcccctcagttacaacgtataggttaaacaaagcttttaaaagctcatgtggtatgacctcaaggttgctaacctggtcactcatggtaattagaaactctgattggcagctttgtatttcttgactaaaaacctaaataaactgattaggttttaggcgttctttcaaagaggttcttgagaagattgagaactatcctatttggtgcttagtgaaaagattttgaattactgtacgtaccagttgttgccatttctttattaaattcagaagtttttttgccaaataacaatttttcaatcttctctgtttgtagacatcttactgggtgatgaataatcctctaagaaaccctctgagctgctaactttttcagggagaaaatcacaagccatcttctcaagttcccctagaaacctgtggaatgccctctgccaagcactgctctggtactggggagtggagtattatgtcttggaagagactcctgctgtgattgtccaggggtacgttctggtctggcttggtgcttgaccttaggtctgcccacaggcttcaggctttcaactttgaaacaaacatctgtgccacacacattttgtaaatgatcccattcagtcttctagaagccttataacagaatcaatattgtttttcccattttcacagatggataataaatctgtaaaatagggataagactaggacctattccccaggattacttctgcagattaaaggagatgttgaggccaggtgcagtggctcacgcctgtaatcccagcactttggggggctgaggcaggagaatcgcttgaacctgggaggcagaggttgtgatgagccaagatcgtgccattgcactccatcctgggctacaagagtgaaactccgtctcaaaaaagaaaaaggagatgttgaatgggaagtcagcaagggtgctagaatgtagcaagtattcttcaggtgttagtgatttctgttgttcgggaagaggagggttatggaggaagagtatgggatttaggtgggttaagtgatttgcccaaagtcaagaggttagtctttaacctttggcagaagcaggatttgaagtgagttttcacacccctcttccctggtcagtgtgttgataacagcccacccacctgtggttccagggtgttcttaagaagccaaggttgtcttgggtgtggtagctctttgaaaggtagaaagttccaccaagaaggccttttttcttgaatactgcttagcttccttgtcaggctccaagatgcagattgcctgtgggctatctctctccacagataaacctactcacatcttcaggacagccttttttttttgagacaggagtcttgctctgttgcccaggctgtagtgcagtggcacaacggggtcccacaggcaagtgctggggaaaggcccacccagccatcaggtagcctgtgtgttctacaaacagcagctggcagcactgtctcctgccggacattcctgccacccgacatcaaagctggtgggtgaccttttcagccatttgacattcctcccagaagaacctctgcctcccagaggtttaagcagttctcctgcctcagcctcccaagtagctgggctatttttttttttttttttttgagatggagtcttgctctgtcgcccggttagagtgcagtggtgcaatctcggctcactgcaacctctgcctcccgggttcaagtaattttcctacgtcagcctcccgagtagctgtcaggtgcacaccactacacccagataattttgtatttttagtagagatggggtttcaccatgttggtcaggatggtctcaatctgacctcgtgatccgcctgcctctgcctcccaaagggctgggattacaggcatgagccaccgcgcccagccttaatttttgtatttttaatggagatggggttttgccatgttggccaggctggtcttgaactcctgacctcaagtgatctgtccgcctcagcctcccaaagtactgagattacaggcatgagccaccgtgcccagcccatcttcatcttctttacttgaacttaattctttttcatgcatcttcccttctttcctcttttctcctccacccaaatgtcttaactgttaacattcccaggtgtttggtcctgggcctctggaggttgtgaaggagcactgctcagtcctcccttcaagaaagcagcttcaaggagttcaattacaaaagctcctggcattggggacctgccgccatgttcctgcccagggcatgctggtcctggctgtcaccaagcacagtggaggtcaggtgctaggccatttctgcccgacacaggcctcctctaatgagcagtctgaggccaggcacaggaggctgaggcaggagaatcgcttgaacccaggaggtggacgttgcagtgagccgagatcgagccactgcactccagcctgggtgacagagtaagacttcgtctcaaaaaataaaaaataaaaaaatactgagcagtctgcttgggcgcttccatcagcctggccatgacatctttggagctgtcctgccctcttttgccccggtgttccttggcccacctgtcagacctacatcataggctcttcctgtcttctgtttcctctcccctttctctaacataggtgtttctcctgagaaagaaaaaaaccacctgtccctgacattcagaagctgacaacactgttcggtcatgccattctcctgttggacataaacagtctctgaatgccaaccccaaagttgctctcaggccatgataaaataaaccacttaataattttgtctaagcacgtacaaagaaaattcaaggtcagtttaccactcacaaaataccaaacatccttctgctggttaaaacgagtgacagctgccgtgtgtgtgtgtgtgtgtgtgtgtgtgtgtgtgtgtatgtgtatatgcgtatatatgtgtatgtatgtgtgtatatatatatgtgtgtgtgtatatatatatatgcaattatacctttatccctactctagtccaccttcctataaataagatgtattgagatgctcagtgcccccattctgacagcatccaatcgagtgaatcctcacttccttgaaatcacccaaccagggccagaatcctaaaagaggttctttgtgacaccctctgtctgagaagtcctatggttctctgtgatgaatagacccaacttgttcaaatacaggcatttctggtgggctttggctgaaggcattcacaccccccagtgaatgtcttgcacttctaattgtgtctcggggcatgcctggtggaggacctgactgagacaattgtgactggatgtggtctgagagcaggcagtaggatgaggcttggggactggctcactcactgcccaactggtagcaaaacccatctggagcagcgtgtgaggtatggacactcactcacacgagggggtggcccagttgctgaggattccaccagtggtaccctgggaaaatatccctgtggaggggaatgggaggagtcaaactgtggaagataagaggagtactgcacacaaggacagtagagtgtctgttccctgcagagggatagtgaggaactgatgaggtgactgtgagtgcccggggcctctgtcgttatcttggaggatcactttgaggtcaggagttcatgaccagcctggccaacatggtgaaaccctgtctctactaaaaatacattaattagcatggtggcgggtgcctgtagtcccagctactcgggaggctgaggcaggagaatcgcttgaacccgggaggccgaggttgcagtgagctgagatggcgccactgcaccccagcttgggtgacagagcaagactccgtctcaaaaacaaacacacagtactgcatcctgggggtggaggtgaggtgacggtagagatcagtgctacccttggaaatctgacagatacagtaagatggtccctatcatagttccatttaatttgccagcctcatctgcagaatccagatggatcctggagaaaaattaaccaagtagcctcaatcacaaatgttgggttggatattacatcagtgttagagcagttaagggctcaggtatgtggtgtgcagccattgactgggtgaatccatttttacctaccccaattacaaaacagtttgctttcatgtggaacagatagtattcctttcagttttgctgcaggaacatattaactcttccacccctgtcataatacagcctgaagagatttaccattaaatactgtttttttctctctcttaacttaatcccgaattggataatttctcttcatcttcactgtcacctctacgccatcactgtcatctctagaccgctctgctgttgagagattgatggaatcattatgcaaactaaaatagaatgttttatctatcaaattgtatttctttgtcaatagtgttagggcacagtaggttcatttactgctggtaagggtgtaaattgttagaaactttctgaatggcagtttggtaataacaaacaaaaagcttaagtttgtgtccttaaatgccttacttcaatacccaaggcatatggcctcaataaaaaattatggaagcatgcaaagattttgttaacaaagatataatcattgcagggtagaatttagaaatttaagactgaaagatcttttcagtcacctgcagcaagaaaggagtcaaaacctatgtacgatctcaactagtaaaattttctccttgcccagggatcatgctgagtttaaggacagaaatgcaaagtgcagcctgggaaagtgtttcaacacacaaaaatagaaccacctgtatgtagtctttttgaaagcacaaaataaagagcagtcctacagggttcactgctatgtcctgaatgttgatgtcccttccaaaattcatatgttggaacctaatgtcaatgtaatagtattaagaggtggggcttttgggaagcaatggagtcatgagggcttcaccctcatgagtaggataagtacccttacaaaagaggctcagggaggcgctcttgcctcttccaccatgtaaggacacgtagcaggcacccatttctgaagaatgggccctccccagactccatatctgctggtgccttgatcttggacttagcctctaggactgtgagtgacatatttctattgtttataaattatccagtataagtaagatattttgttagagcagcctgaacgaactaagacactctaagcgggaaactcacaaaaaatatttggtagtgaaaaacagtatggtgtgttaatgtatggtgacaagtgtttgtttgcatttaaaaatgcattggagcctcgttttgattaggcagtaaatttacctttaatacgtaagtttgacagttatatgtaatcagcttttttttttttaagatggtgtgattgaggttaatgtgaactgaactttctatttctaagctgtcttcatctaattttacctttctgtggaaaatcaatacaagtcaaccatttttattgcccagttattcaaagttttattcaaagagcaaagatttgacaatgcatagaattaacattggtttgtgggccaccttctgggccagcaccaaagactgaaaaaatattttgccccctaaaagttgttattgagtcttgtcaaatcacattgctctgtcagaaggtaagacaaatcagtgtggactgagagcaaggtcagcaccgtgaacagccattgcggttcctttaacccactgggaattcatgcagtgaagaagcaacacaccatgaggcaaatggctcaaacccaaagaccagaggttcaggggatatatatatatatttttttaatctgtagagatgggatctcactatcttgcccaggctggtctcgaactcttgggctcatgctgtcctacctcagacttccaagtagctgggttttctttgggctaattatttttttgtagagatggaggtctcgctgtgttgcccaggctggtctcaaattcctggcctcaagctctcctcccatctcagcctcccaaagtgttgggattacaggcatgagccatgtgcccagtctagaagatctttgacttcaaagaacagataatctagagaccttcacaagtgatcatgttggcactatggtcattacactgagacctataactgggctaggattggttatttacagaaaaaccttgtggtacttaattccaattcatgttaatttatgttatcttgcttaatccttgcaaagcccttttagaggtgggtgttatcccatctataatctgctgcttgtcttagaccaaggaagtgaaagtattcagtccaagcatgctaccatccatttctggtaggtttggtttgtttttagttggctttcctgtttaactgttatttgtcttcctattgaggttagatgtgcattttggaattgcatcattttacatagaaacagctttccagtggagttgactagcatcctaaggacaagtacaaccacttttgaaatagatcatggaaatcacaaagtctgatgttccacaaaatggagtatgatgttatggacactagaaatacaaggtatgggtcattagtaacgctaataacattttcctatagatgacttttaataacactggtttaatgtcaattttttttttttttttttttttttttttttttttttttttttttggagacagggtctccctctgtcacccaggctggttggaatgcaggagttcgaacttggctcactgcaacctctgcctcctaggttcaagtgatcctcccgcctcagtcccccaagtacctgggaccacaggcacacgccaccatgcctggctaatttttgtatattttgtagagatggggtttcaccatattggccaggctggtctcaaattcctggactcaagcagtccatctgcctcagcctcccaaagtgatgggattacaggcgtgagctgctgtgcctggcagaacagtatgaagtgttaacgccaaaatttgttttagctatcatatataaatcataagcatattatttggttggttggtgttagttcattccttcaatcggatgatttaaaataaatgtttttcaagtatcctctgtgatgtatcccaaaggttagcttagaaagaaaagtacttggtgaaccattcctggtgcggagagccctgtttctgctggacttctttggcttgggccgtttcaccatctggggtcctaaaagcaaaaaaaggtttttttatatggttttgaaaactatgcaagaagcagcttaatacccaccatcttttcagggaaagataactgcttgtttactcttcaaaaacacccaaatgggactggccaacattagtagtgggaaacaaattgtaaaggatggggctggggagggagtacctaatcctcatttggaaaacagaaggttcaccattgtttggttctccattgttcctttgagacttagtggttgtagctctaataatgcaggattaaccaaacctacagatcaagagactttgtttttattttttgtgacagagtctccctctgtcacccaggctggagtgcagtggcatgatctcggctcactgcaacctccagcctcctgcgttcaagcgatcattgtgcctcagcctcccggggagctggaattacaggcgcataccaccacacctggctaatttttgtattttttgtagagatgggtttcaccatgttgcccaggctggtctcgaactcctgaccttaggtgatccacccacctccatctcccaaagtgctgggattacaggcgtgagccaccaagcccggcccgattaagagactttagaattccaaggtgatagagtaaatcttgaggaataatgttagtaataatactgaaactatattgaagatttttgtgccaagtcctgtgctaagcacatcctatggattaattcctttagtctcacgtcagtctgatgagataggtgctgtattatcttaattttaaaggcaaggtatatggagacctggagaggtcaagtgacctgtccaaggccacagagctaagaatgaggaagactgtaatttgaattcagacctccaggccagatggagtccaccttttgtataacccatgctgaagttttcaggtaagtgattcagtgtcccttgtctaatcatccatgaaaaaaggccttctggaatttggtaccaggtgctagaaagaatcctacttcccctcttatctacagggaaatagaataagggcccctgtccccaacatcccccaaaccttgtggcagtttttgcatctgtagactggttgggtttgtaggtccggccacagctggggcttgggtccaagctgggtgatgtagttattggaggggcattaatcctggaactcagatcgccactcagaaagttctttgcataggaggcgaggttcggcacgctgaccacgcggctgggcacgtcctccaccttctttttctgtttgtattaatggacaggttagtgcaatgcaatgcaaaaaacaaaataaagcattattgtaaaagcaaataatgctcacccaatcaaaattgtatcggagaagaagcaacaatttcatttatacacttacatgctattttttaaagcacttttccctccaatcttcattttgtattataaataaatatgtatgttcacaacctcttaaccaaaa

SEQ ID NO: 152276 - DNA, 879 bp, Homo sapiens
  Payload ID: 9957
  Gene Symbol: MED28
  Gene Name: mediator complex subunit 28
  ENST ID: ENST00000503945
  CDS Start-End: 1-540
ccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacacatcttactgggtgatgaataatcctctaagaaaccctctgagctgctaactttttcagggagaaaatcacaagccatcttctcaagttcccctagaaacctgtggaatgccctctgccaagcactgctctggtactggggagtggagtattatgtcttggaagagactcctgctgtgattgtccaggggtgtttctcctgagaaagaaaaaaaccacctgtccctgacattcagaagctgacaacactgttcggtcatgccattctcctgttggacataaacagtctctgaatgccaaccccaaagttgctctcaggccatgataaaataaaccacttaataattttgtctaa

SEQ ID NO: 152277 - DNA, 758 bp, Homo sapiens
  Payload ID: 9957
  Gene Symbol: MED28
  Gene Name: mediator complex subunit 28
  ENST ID: ENST00000612711
  CDS Start-End: 4-582
aacatggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggcaggcatctgccaacatccctgcacctctgaagccaacgtgagcaaagggcagaggcagttggcctatgagtgggctgatgcgtgaggttggccacacattccttcctgtggacttgacattttggaagaactctttgccagataatgagttcattttagttttatgctcccattgaaaaattttccactatttttataagctgttaatttcttgagtactttataacatgtctgtagcttggataaaccaagtaagtattt

SEQ ID NO: 152278 - DNA, 3653 bp, Homo sapiens
  Payload ID: 9958
  Gene Symbol: MED29
  Gene Name: mediator complex subunit 29
  ENST ID: ENST00000315588
  CDS Start-End: 50-715
aattgcctagggggcgggactaactagcaaacggggactagaaatagggatgctgaaaagcaacggggagagacgcagtcgtaacgcacttccggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcctcctgtcctggaccccacgtctgcaaggaaaccctaggaccatggatacctctgtgattcacgctgagcccaagtccccacactggaaaactgggaaatggccagctgtgtgtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctcaaaaaaaataaaaaactgaccatctagtccttgtcatctgggcaccctcacacatctccttaaccacacttaatctccaaataagtacgataacatagtcatagtcccacccaacatgatgcagttatcttgcatacaactgaagacaactaaccctttccccaacagagcccaccagcagtggtggagatgtcggtccatgagcgcacacacaagactgagggactgtcggccctcccaggtggtgtcaacacaacatcacacacaggtgggggggcctgatagcccagcacccatgatacagggcctaccaatgcttaaaaccacacccagggagcccacagaggcactcagtgggtggtggggtgatggatacacatctatcaggcacagggcggaggtgggcaccactgagttgcactcagcaaacacattgggtatcttgtgcccaaggcctgtatttgtggagctgatgttctagtgagagacagtaaatgtgacaaaagtaaaatatatcagatggtgagaaaacagaaaaatgagatcagaagtggagatgttggggccaggcacagtggcccaggcctgtaatcccatcactttgggaggtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaagtggaggtgtttacaccagcaaaatactcattttttaagtgtaattaagttgaagatcaaaaaatggaaatgtataattaaatcatacttagcaaatctaacacatgaaatgtaacatctgcatatggagaatcgtgttactttattgaaaaacattaaaagtttgagaacttaagttggattgtggtttcgtgagcattcattatggtttatatatgttccatgtatttattattaaatagatgacaa

SEQ ID NO: 152279 - DNA, 2941 bp, Homo sapiens
  Payload ID: 9958
  Gene Symbol: MED29
  Gene Name: mediator complex subunit 29
  ENST ID: ENST00000599417
  CDS Start-End: 58-348
attggcttaattgcctagggggcgggactaactagcaaacggggactagaaatagggatgctgaaaagcaacggggagagacgcagtcgtaacgcacttccggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcctcctgtcctggaccccacgtctgcaaggaaaccctaggaccatggatacctctgtgattcacgctgagcccaagtccccacactggaaaactgggaaatggccagctgtgtgtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctcaaaaaaaataaaaaactgaccatctagtccttgtcatctgggcaccctcacacatctccttaaccacacttaatctccaaataagtacgataacatagtcatagtcccacccaacatgatgcagttatcttgcatacaactgaagacaactaaccctttccccaacagagcccaccagcagtggtggagatgtcggtccatgagcgcacacacaagactgagggactgtcggccctcccaggtggtgtcaacacaacatcacacacaggtgggggggcctgatagcccagcacccatgatacagggcctaccaatgcttaaaaccacacccagggagcccacagaggcactcagtgggtggtggggtgatggatacacatctatcaggcacagggcggaggtgggcaccactgagttgcactcagcaaacacattgggtatct

SEQ ID NO: 152280 - DNA, 546 bp, Homo sapiens
  Payload ID: 9958
  Gene Symbol: MED29
  Gene Name: mediator complex subunit 29
  ENST ID: ENST00000600973
  CDS Start-End: 36-380
gtcgtaacgcacttccggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaggtctccctctgtcacccaggctggactacagtggcacgatcttggctcattgcagccttgaacacctgagttaggagatcctcttgcctcagcctcccaagtagccaggactacagacatggctacagactacagatgcctggctaatttaaagagcagtgatggacccatacagcgctttgacaagtgcctggaagagttctatgcactctgtgaccagctggagctgtgcctg

SEQ ID NO: 152281 - DNA, 2490 bp, Homo sapiens
  Payload ID: 9958
  Gene Symbol: MED29
  Gene Name: mediator complex subunit 29
  Uniprot ID: Q9NX70
  ENST ID: ENST00000599213
  CDS Start-End: 28-630
gcacttccggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcctcctgtcctggaccccacgtctgcaaggaaaccctaggaccatggatacctctgtgattcacgctgagcccaagtccccacactggaaaactgggaaatggccagctgtgtgtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctcaaaaaaaataaaaaactgaccatcta

SEQ ID NO: 152282 - DNA, 1471 bp, Homo sapiens
  Payload ID: 9958
  Gene Symbol: MED29
  Gene Name: mediator complex subunit 29
  Uniprot ID: Q9NX70
  ENST ID: ENST00000594368
  CDS Start-End: 31-621
aacgcacttccggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagca

SEQ ID NO: 152283 - DNA, 636 bp, Homo sapiens
  Payload ID: 9958
  Gene Symbol: MED29
  Gene Name: mediator complex subunit 29
  ENST ID: ENST00000596297
  CDS Start-End: 12-636
acgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctggtaagaagccttctggacacgggcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtg

SEQ ID NO: 152284 - DNA, 3565 bp, Homo sapiens
  Payload ID: 9958
  Gene Symbol: MED29
  Gene Name: mediator complex subunit 29
  ENST ID: ENST00000615911
  CDS Start-End: 38-703
ggcgggactaactagcaaacggggactagaaatagggatgctgaaaagcaacggggagagacgcagtcgtaacgcacttccggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaatggacaaaagagcagtgatggacccatacagcgctttgacaagtgcctggaagagttctatgcactctgtgaccagctggagctgtgcctgcgcctggcgcatgagtgcctgtcacagagttgtgacagtgccaagcactctccaacgttggtgcccacagccaccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcctcctgtcctggaccccacgtctgcaaggaaaccctaggaccatggatacctctgtgattcacgctgagcccaagtccccacactggaaaactgggaaatggccagctgtgtgtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctcaaaaaaaataaaaaactgaccatctagtccttgtcatctgggcaccctcacacatctccttaaccacacttaatctccaaataagtacgataacatagtcatagtcccacccaacatgatgcagttatcttgcatacaactgaagacaactaaccctttccccaacagagcccaccagcagtggtggagatgtcggtccatgagcgcacacacaagactgagggactgtcggccctcccaggtggtgtcaacacaacatcacacacaggtgggggggcctgatagcccagcacccatgatacagggcctaccaatgcttaaaaccacacccagggagcccacagaggcactcagtgggtggtggggtgatggatacacatctatcaggcacagggcggaggtgggcaccactgagttgcactcagcaaacacattgggtatcttgtgcccaaggcctgtatttgtggagctgatgttctagtgagagacagtaaatgtgacaaaagtaaaatatatcagatggtgagaaaacagaaaaatgagatcagaagtggagatgttggggccaggcacagtggcccaggcctgtaatcccatcactttgggaggtgcaggcaggcagatggcttgagcccaggaattcaagaccagtccgagcaacatagcaaaagcccttatctgcaaaaaattcaaaaattagccaggtgtggtggtgcgtgcccaggttcccaggtactcggaggctgagaggtgggaggatgccttgagcttgagaggttgaagctgcagtgagctgtgatcgcaccactgcactccagcttggttcatggagaccctgtttttttaaaaaaagaagtggaggtgtttacaccagcaaaatactcattttttaagtgtaattaagttgaagatcaaaaaatggaaatgtataattaaatcatacttagcaaatctaacacatgaaatgtaacatctgcatatggagaatcgtgttactttattgaaaaacattaaaagtttgagaactt

SEQ ID NO: 152285 - DNA, 985 bp, Homo sapiens
  Payload ID: 9959
  Gene Symbol: MED30
  Gene Name: mediator complex subunit 30
  Uniprot ID: Q96HR3
  ENST ID: ENST00000297347
  CDS Start-End: 165-701
gtgttacgtcacagtgggcggaagtcgcggccgctgttttgaaatcgggccgcggggggtctctcaagctggttccaacgctgaggccccacagcctcccaattccgggcagacccctgacacctgctgtctggccccttccggcctgaagctgcagccgcgccatgtccacccctccgttggccgcgtcggggatggcgcccgggcccttcgccgggccccaggctcagcaggccgcccgggaagtcaacacggcgtcgctgtgccgcatcgggcaggagacagtgcaggacatcgtgtaccgcaccatggagatcttccagctcctgaggaacatgcagctgccaaatggtgtcacttaccacactggaacatatcaagaccggttaacaaagctacaggataatcttcgccaactttcagttctcttcaggaagctgagattggtatatgacaaatgcaatgaaaactgtggtgggatggatcccattccagtcgagcaacttattccatatgtggaagaagatggctcaaagaatgatgatcgggctggcccacctcgttttgctagtgaagagaggcgagaaattgctgaagtaaataaaaaactcaaacagaagaatcaacagctgaaacaaattatggatcaattacgaaatctcatctgggatataaatgccatgttggcaatgaggaactaagctgatatttaaatttcctgctttacacatgttataccattgttttttccctcaagtattttttccctgtgaagaagattatttatctgcttttattttagtcactaaaactaaagtttttatttttacattgtgatttttacattaaaatattaactttttttaatgctattttatgaaagattattgtaataaactttgatggggtttgtattttggttaatcttcatgaattgaataattgtttttttaaagcaaaataaagttttttaaataaatgttaa

SEQ ID NO: 152286 - DNA, 476 bp, Homo sapiens
  Payload ID: 9959
  Gene Symbol: MED30
  Gene Name: mediator complex subunit 30
  Uniprot ID: Q96HR3
  ENST ID: ENST00000522839
  CDS Start-End: 45-476
cacctgctgtctggccccttccggcctgaagctgcagccgcgccatgtccacccctccgttggccgcgtcggggatggcgcccgggcccttcgccgggccccaggctcagcaggccgcccgggaagtcaacacggcgtcgctgtgccgcatcgggcaggagacagtgcaggacatcgtgtaccgcaccatggagatcttccagctcctgaggaacatgcagctgccaaatggtgtcacttaccacactggaacatatcaagaccggttaacaaagctacaggataatcttcgccaactttcagttctcttcaggaagctgagattggtatatgacaaatgcaatgaaaactgtggtgggatggatcccattccagtcgagaaactcaaacagaagaatcaacagctgaaacaaattatggatcaattacgaaatctcatctgggatataaatgccatgttggcaatgaggaactaa

SEQ ID NO: 152287 - DNA, 1654 bp, Homo sapiens
  Payload ID: 9960
  Gene Symbol: MED31
  Gene Name: mediator complex subunit 31
  Uniprot ID: Q9Y3C7
  ENST ID: ENST00000225728
  CDS Start-End: 107-502
acagtgccccgggaccggaagagggagccgtggtttccggaacttcgcccgcgtctctgggcttttgctctgtcaggctggtggcgttttggtgtcttcgtttgttatggccgctgctgtcgctatggagacagatgatgctggaaatcgacttcggtttcagttggagttggaatttgtgcaatgtttagccaacccaaattaccttaattttcttgcccaaagaggttacttcaaagacaaagcttttgttaattatcttaaatacttgctttactggaaagacccagaatatgccaagtatctaaagtaccctcagtgtttacacatgttagagctgctccaatatgaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgaggcacttaatacatgtatataatgtatttcttttgtacagtgaagacaaaaaaaatgaaaactcttcctatctacctttattatggtagcccctagaacctttagtgtgctttttcatccaactttttattgttaatagactatttctgttaaacctgaattgttctttgatttccctgtggatttgtaaggtgtttttcttttttacgcatttagcataatcagctgattaagaatggaaaagttaggtgctttagaccaaataaggcactggggcatggggtaggggtgggccaccaagtatactgaattctaaggctagctgttcctgacatatagtagggcaagaccatctcctggaaccttactgtctcagatcaactactctaccactctactctaagatgtagtgagagtagcggagtcactgacctctttaaatcataggacaggaactgcataaaggttcttgaattctgcaggacaggaaataactgtattacctgctttgcaaggtggctttaagaatcactgaatcactgtggcctcacttgacctagtcatggcaggacaactagtggttagttactaactggactcttgactttagaacaaacatgaggagcctcaaatacttgtgttcatttgggaaagctaccattgatttgggaggtaccacaaaccaggtgctatgttaagtgcttccttgaattctcattttattctaagaaccttgtttatagaagagaaaactgaggtttggacggggtgagtaacttgcctgtggttacacagctagtaagtggtagagtcagtgtgactgactcccagcttggagttcttcccagaactgggttatagagtctttccggccgctctccgccacctgcctcatcccaagtaaagcacattgagacagctgcaaaacaaactgcttctagtgctcaggagtctgttttttattaaacaaaacaaaactgcctgaattaagcagaggctagattagaggtcatgtgctttccttcagtggtgaggttaggttctacattccaaaatcaaagaaggggtttcaggaatatcatcagttgctttgcagatggagataacttaaaataaaagatactgatcttttga

SEQ ID NO: 152288 - DNA, 593 bp, Homo sapiens
  Payload ID: 9960
  Gene Symbol: MED31
  Gene Name: mediator complex subunit 31
  ENST ID: ENST00000575197
  CDS Start-End: 107-238
acagtgccccgggaccggaagagggagccgtggtttccggaacttcgcccgcgtctctgggcttttgctctgtcaggctggtggcgttttggtgtcttcgtttgttatggccgctgctgtcgctatggagacagatgatgctggaaatcgacttcggtttcagttggagttggaatttgtgcaatgtttagccaacccaaattaccttaattgtaccctcagtgtttacacatgttagagctgctccaatatgaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgaggcacttaatacatgtatataatgtatttcttttgtacagtgaagacaaaaaaaatgaaaactcttcctatctacctttattatggtagcccctagaacctttagtgtgctttttcatccaactttttattgttaatagactatttctgttaaacctgaattgttctttg

SEQ ID NO: 152289 - DNA, 619 bp, Homo sapiens
  Payload ID: 9960
  Gene Symbol: MED31
  Gene Name: mediator complex subunit 31
  ENST ID: ENST00000574128
  CDS Start-End: 274-447
cttccaggccttactcttggcagggttaatatttggacagagaggagagaaggctcttgtagcgtctagaaagactaagatgatgctggaaatcgacttcggtttcagttggagttggaatttgtgcaatgtttagccaacccaaattaccttaattttcttgcccaaagaggttacttcaaagacaaagcttttgttaattatcttaaatacttgctttactggaaagacccagaatatgccaagtatctaaagtaccctcagtgtttacacatgttagagctgctccaatatgaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgaggcacttaatacatgtatataatgtatttcttttgtacagtgaagacaaaaaaaatgaaaactcttcctatctacctttattatggtagcccctagaacctttagtgtgctttttcatccaactttttattgttaatagactatttctgttaaa

SEQ ID NO: 152290 - DNA, 2022 bp, Homo sapiens
  Payload ID: 9961
  Gene Symbol: MED4
  Gene Name: mediator complex subunit 4
  Uniprot ID: Q9NPJ6
  ENST ID: ENST00000258648
  CDS Start-End: 27-839
gcgccggtggcgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgtatgctttttttttagtttaaatatactgtcagtgtaggtaggaaattatttctgtaaatccagttgcattttataatacttgagtgactaactgaattgaaacctattacaattaatagggttctcaaaggcctattcctattagaagaaataattttttttaataattgaaaaaatttaccacagccttgtctgattttaagaatagattgtgtgaagatttagaatggaaagcaaccatttcttcccttcaccttcctcttcttacagttccccaggagtcatttttaaccacttttaatttctgttggtaacctctgtgtttaggtaatatgcttatacaactatttcttgatgtatcagttttagacaatgtatcttctgatttcaaaggtaatacaacatttaatgtgaaacatttagtgaatacagtaaaggagaaaataaaattgttagcattctacccagagataatatcaattcatattgtagtgtagatttttttaaagttcacatacacttttttgtaaaatgagaataatgtttatttcctgagatactgctgtattttttaattgctaatctgtattcttcaaatgaactgagaattccatttttccatc

SEQ ID NO: 152291 - DNA, 931 bp, Homo sapiens
  Payload ID: 9961
  Gene Symbol: MED4
  Gene Name: mediator complex subunit 4
  Uniprot ID: Q9NPJ6
  ENST ID: ENST00000378586
  CDS Start-End: 86-760
gcacctgcgtcagctcgctctgcgcgtgcgccggtggcgggactctggggaaaatggctgcgtcttcgagtgggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaa

SEQ ID NO: 152292 - DNA, 911 bp, Homo sapiens
  Payload ID: 9961
  Gene Symbol: MED4
  Gene Name: mediator complex subunit 4
  ENST ID: ENST00000417167
  CDS Start-End: 197-911
cttcgagtggtgagaaggagaaggagcggctgggaggcggtttgggagtggcgggtggtaacagcacacgagagcggctgctgtctgcgcttgaggacttggaggtcctgtctagggccgggtgtggtggctcacgcctataatccgagcactttgggaggccaaggcgggcggatcattggaacttcttcacagaatgaagctgctctggtggtgtgactggcttccagaaaggtctcatgtgttcactcagagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacgg

SEQ ID NO: 152293 - DNA, 460 bp, Homo sapiens
  Payload ID: 9961
  Gene Symbol: MED4
  Gene Name: mediator complex subunit 4
  ENST ID: ENST00000495013
  CDS Start-End: 1-460
gggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtaagatggagtttcaccatgttggccagactggttccgaactcctgacctcaagtgatccacccacctcggcctcccaaagtgctgggattacaggtgtgagccaccgcgcctggcaagagccttctttacttagcacagaagattgcttaataaatacttcttggttata

SEQ ID NO: 152294 - DNA, 1995 bp, Homo sapiens
  Payload ID: 9962
  Gene Symbol: MED6
  Gene Name: mediator complex subunit 6
  Uniprot ID: O75586
  ENST ID: ENST00000256379
  CDS Start-End: 31-771
gaaagagaacctgtaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaagaagaaaagatattattcccatcatgatttcttgtgaatatttgttatatgtcttctgtaacctttcctctcccggacttgagcaacctacacactcacatgtttactggtagatatgtttaaaagcaaaataaaggtatttgtatatattgcttcatcatgacttttttcttcatcataactgatatttttcagatgcactttgaagacataaaggatgttaaagtagtaactaagcatatttctttttgttcagttacataatcctcagtattaaaataaacagttgctgacattttggaagatgaagaaaaggaaaaacctcactcaccaataccattaccctataaatactgtaacagtgttgtgaattttaatcttattctgtgtgtagatacttcttttttcaataaagaaaaggaattttattttttttaaagttatggaggctgagaagtccagcattgattggctccatctggtgagggccttcttgctggtaggaagtctgcaaagtccctaggcagcacagggtatctcatggcaagggggctgagtgtgcttgctgcatgtagatgcttttaaaactgtactttaatcattcctttcgtacaattttactttattatatctgttgtaagcttttccccatgtttatgtagtttttatagactgttttagtgtccgaatttctgtaaatgattgtatctcagttttctttctgtcttatatttgggatttttcccagtttacattattttatataagactgctgtgattatatctttgtataatgcc

SEQ ID NO: 152295 - DNA, 931 bp, Homo sapiens
  Payload ID: 9962
  Gene Symbol: MED6
  Gene Name: mediator complex subunit 6
  Uniprot ID: O75586
  ENST ID: ENST00000440435
  CDS Start-End: 19-564
gtaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggc

SEQ ID NO: 152296 - DNA, 1507 bp, Homo sapiens
  Payload ID: 9962
  Gene Symbol: MED6
  Gene Name: mediator complex subunit 6
  Uniprot ID: O75586
  ENST ID: ENST00000430055
  CDS Start-End: 19-780
gtaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgagtttattttccttttacaagcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaagaagaaaagatattattcccatcatgatttcttgtgaatatttgttatatgtcttctgtaacctttcctctcccggacttgagcaacctacacactcacatgtttactggtagatatgtttaaaagcaaaataaaggtatttgtatatattgcttcatcatgacttttttcttcatcataactgatatttttcagatgcactttgaagacataaaggatgttaaagtagtaactaagcatatttctttttgttcagttacataatcctcagtattaaaataaacagttgctgacattttgg

SEQ ID NO: 152297 - DNA, 975 bp, Homo sapiens
  Payload ID: 9962
  Gene Symbol: MED6
  Gene Name: mediator complex subunit 6
  ENST ID: ENST00000554963
  CDS Start-End: 7-756
ggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagaaagctgtgtgaagagacaaagggagaatgccatgtgaagatggaggatcggagtgatgcgtctacaagccaaggaatgccaaagatttccggccagtcaccagaagctaagaggcaaagaaggattcccctacaggtttcagagaaagcatagcccatatccctgctgacactttgattttggattttcagcctccagaattttgagacaataaatttattgtttaagtc

SEQ ID NO: 152298 - DNA, 1700 bp, Homo sapiens
  Payload ID: 9962
  Gene Symbol: MED6
  Gene Name: mediator complex subunit 6
  ENST ID: ENST00000615788
  CDS Start-End: 54-827
aggcttacgtttactttgcgccggaaagagaacctgtaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcattacataatcctcagtattaaaataaacagttgctgacattttggaagatgaagaaaaggaaaaacctcactcaccaataccattaccctataaatactgtaacagtgttgtgaattttaatcttattctgtgtgtagatacttcttttttcaataaagaaaaggaattttattttttttaaagttatggaggctgagaagtccagcattgattggctccatctggtgagggccttcttgctggtaggaagtctgcaaagtccctaggcagcacagggtatctcatggcaagggggctgagtgtgcttgctgcatgtagatgcttttaaaactgtactttaatcattcctttcgtacaattttactttattatatctgttgtaagcttttccccatgtttatgtagtttttatagactgttttagtgtccgaatttctgtaaatgattgtatctcagttttctttctgtcttatatttgggatttttcccagtttacattattttatataagactgctgtgattatatctttgtataatgccttttcagtgtttggtatttatttccttaggatagagttccagaagtggaatcactagagtctctgcatttttattgctcttagtccatattgctaagttgttcctcaaaatgttggactagtgatcactcaaacagcgaagtttgaaagtatgtatcaggttttccagaattgctaccactgaattttgtcatttatgtttttagtgttaagtagcaaaagtggtattttagtatttaaagtagttgaagaatttctcatctttttctgcttttatgaaatgtctaattttatgtattgtgtgagatttttgtctttcaacttcttattttgacataatttccggcaaacagaaaagttgtaagaata

SEQ ID NO: 152299 - DNA, 2402 bp, Homo sapiens
  Payload ID: 9963
  Gene Symbol: MED7
  Gene Name: mediator complex subunit 7
  Uniprot ID: O43513
  ENST ID: ENST00000286317
  CDS Start-End: 383-1084
ttcacgttaagtcttacaagagcatgttaaacattaaaacataagattgtttctggtcaataaggggtctataaaaaataaagcaataaggtgtcttgttcaattttatgccttaattcaaaaagaaacgaagaaacggaaccctcagctacgacttttaaaagtcagtaacgggtggatgggaggagtcaaacatacgtaggcgcaacagcgagggatcggtctgaggcggagctagaatttcgttaaaggacagctcttacagccaatcaaggacagagtcggtggcttcttcccggaggagaccggaagttggtttcggctgcagaggggaaggcggctaccagtgtaaagccagagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatgtttctttttctttttttccttttgataatagcatcatatattagttcattttcttttggacagtcttaagagaagtttcactaaaaatgtaaacagctttaatcttgactccaaatttttcaattatgagatgtcataggcagtaatttcgctgtataacaagcatagacaaatgagtgtccctgcactaagaagaatcactttaaaaagcaaagtgttagctgctgttgtatgggacattcctatgttttagagttgcagtaaaactttgatgataacctcaataatagcaaagttttcgtctttgaaaaggggatttagcatttgctttaagaatgatagataaatggatattaagctctctacatgtaaaactatgaaatctttagacttattccattaaaaattttgcttaagctccaaaaagtagcataacatgttgatagagaggagcccagtagagttataaaatagaaacttcattttttcctcatgactgcttctgtaaacccactagctcagtcttttctccctatcctgaatggactcttgcagggaagtcccataaattgttgtttttttttccagtcactcaggtaataagtcctttggtcactttaagttacagacattaattttagtaattaagatgtctgtgtcattagctatacattttctttaaagctaagctcagacttgtttaagtccacaatgggaaaggggtttgatggcagagactgctaggtgtctaccaaagattcttgctctttgaagatatgttgtcaagatgtggcaatccagccagggacatttccctactcccagcatctctgtgagaacatatgactaagtcgtaggcggtgaaatgtgggcataggaatccaggcttgccccataaacatttcttgcatgatcctccattctcttctcccagctgctggttggacggtcgtatccaggataagtttggaagccaccgaagatggcaaagattgtcagtctggttctttgaatgaccgtgaggactaagtcttcctttcagtaactccactctgcccctagctaattggactttatatgagcactttcttctcttcttcccccgactgtccatctgctcttccaccaaggtgttagtggagagttgaccttgtgtctgaggatctctgcctgccgttttcttaatgtaggcccgtggttcttaaagtgtgtggtcctggaccagcagcattggtatcacttggggacttactagaaataaaagttttagtataatccgtaggttcagaaaaataaaaaataaatgagggtt

SEQ ID NO: 152300 - DNA, 1382 bp, Homo sapiens
  Payload ID: 9963
  Gene Symbol: MED7
  Gene Name: mediator complex subunit 7
  Uniprot ID: O43513
  ENST ID: ENST00000420343
  CDS Start-End: 393-1094
ttttcttccggaccccgcagcttcctctgtgctgggctgggaactggggaggcatggctgagttcggcctccaaaggcggtctttcgtctttctctcccgagtctctccgagagtgcggtctctccgagagcgcggaggcctcggggtggacagcctggaggagggggctctaagcgtggcagtctcggggcttcctccgtgttgggacgccgagccggagtggaggttgggagacctggcgtctagtccccgcgccgctgtttttctaagctgtgtggccttgggcgagtcatttgccctctccggctctttgtaacatgagagtagccctccctgcccttccttcttctgggagcagttatgaaacagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatgtttctttttctttttttccttttgataatagcatcatatattagttcattttcttttggacagtcttaagagaagtttcactaaaaatgtaaacagctttaatcttgactccaaatttttcaattatgagatgtcataggcagtaatttcgctgtataacaagcatagacaaatgagtgtccctgcactaagaagaatcactttaaaaagcaaagtgttagctgctgttgtatgggacattcctatgttttagagttgcagtaaaactttgatgataacctc

SEQ ID NO: 152301 - DNA, 979 bp, Homo sapiens
  Payload ID: 9963
  Gene Symbol: MED7
  Gene Name: mediator complex subunit 7
  ENST ID: ENST00000524289
  CDS Start-End: 394-979
gatctataaaatgagattacaggagatgttttgaaagacatgttcccattagaaatgtccatgtgatggctgggtgctgtggctcatggctgtaatcccagcactttcggaggctgaggctggcggatcacctgagaaacgaagaaacggaaccctcagctacgacttttaaaagtcagtaacgggtggatgggaggagtcaaacatacgtaggcgcaacagcgagggatcggtctgaggcggagctagaatttcgttaaaggacagctcttacagccaatcaaggacagagtcggtggcttcttcccggaggagaccggaagttggtttcggctgcagaggggaaggcggctaccagtgtaaagccagagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaaca

SEQ ID NO: 152302 - DNA, 1483 bp, Homo sapiens
  Payload ID: 9964
  Gene Symbol: MED8
  Gene Name: mediator complex subunit 8
  Uniprot ID: Q96G25
  ENST ID: ENST00000290663
  CDS Start-End: 45-950
ggaaaaccggaagtgaaatcgtggcagccgcctcggccgccgcaatgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 152303 - DNA, 1186 bp, Homo sapiens
  Payload ID: 9964
  Gene Symbol: MED8
  Gene Name: mediator complex subunit 8
  Uniprot ID: Q96G25
  ENST ID: ENST00000372455
  CDS Start-End: 331-870
cagccgcctcggccgccgcaatgcagccctcctttctatgtgtcatactcgtttatctgggtgaccaacctgttcctattggtgcagagagaggagaagcagcttgaggcatcattagatgcactgctgagtcaagtggctgatctgaagaactctctggggagtttcatttgcaagttggagaacgagtatggccggctgacctgctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctaca

SEQ ID NO: 152304 - DNA, 1924 bp, Homo sapiens
  Payload ID: 9964
  Gene Symbol: MED8
  Gene Name: mediator complex subunit 8
  Uniprot ID: Q96G25
  ENST ID: ENST00000372457
  CDS Start-End: 45-851
ggaaaaccggaagtgaaatcgtggcagccgcctcggccgccgcaatgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttg

SEQ ID NO: 152305 - DNA, 2228 bp, Homo sapiens
  Payload ID: 9965
  Gene Symbol: MED9
  Gene Name: mediator complex subunit 9
  Uniprot ID: Q9NWA0
  ENST ID: ENST00000268711
  CDS Start-End: 57-497
gtagagtgcgcgacgcttttggcgacccgacctctggctaacctacccccggagccatggcctctgctggggtggcagccgggcgacaggcggaggatgtattgccgccaacgtccgaccagccgctgcctgacaccaagccgctgccgcctcctcagccgccgccggtccctgcgcctcaaccgcagcagtcgccggcgccacggcctcagtcacctgcccgcgcgagggaggaagagaactactcctttttacctttggttcacaacatcatcaaatgcatggacaaggacagcccggaggtccaccaggacctgaacgccctcaaaagcaagttccaggagatgcgcaagctcatcagcaccatgcccggcatccacctgagccccgaacagcagcagcagcagctgcagagcctccgggagcaagtcaggaccaagaatgagcttctgcaaaagtacaagagcctctgcatgttcgaaatccccaaggagtagagtgaggctgacttccttagaaagagggggaagccaatggcctgtctccccactaccatccccaaacgctccttggggcgtggttcctgtggaccccagctcagctcgtcaagctgcaggggcggggctcctgtgctgctgcgcgcgcttcgcctgtgcgggagccagcgcagagcttggctgcgccgggggttcctcgtgtagatccatatgtctagatgcataataactggagtgcctgctggtggaagtcagaatgctcctggaggctgcagagggggtggaggactctcccctgcctctggggagggggccatctgctgcgcccggccccactgacagatctgaagagcacagtaggaagggaggcggctcctctttgcttccttccctctctctcctcccacccccataggatcagtgtgtaccaggtacacattgttcctgttaacagcagcttcttgaaacatttgcatagaattcactggacgaattaagcctgcactcatatggcatagaattgtgagagaatgttttgaaaggccagagggtggcctttttccccaaacagtttggttccttttatgtttgagccagtgaagggaactacgctttgggggcttcagcctagagccctgccaggcagcccctggctccaggttccctgcctcctagcgctctcctcgccttcagctcttgctcccttcctcgttcatcaccctcagtcagtgcccaagagtggccaaaccgcttcacatctgcagtgcttccccagggttgacaaggggccgtcctttccacacaggccagaagaggtcttcaggcgaaccgaccttcccccttctggcatttcagattccccttgctctggttaaaaggtctttccctcgtggcctttgcacttgcggcagcaacgtgtactacactgcagaagggttcagtatgcaccttgtgttgagagagaggcaaccctgggggccagttcaggtggtccccaaccataagctaggtctgaaagttacacagccaagtttgagctcttaaaagttgatgaacagcctcatttccccagcttccctgatttcttccagatgggacgttttatttgtgtgctctcccttgactgtcagattgaagtaagagcagttctctccgttgcctctcgaggaggaggtgcgaagtcctggagtattgtttgggtctcggaatgggcgcataacctgcgctgaccagtttaggggcttagcagatgcctgccagctgacctcgttggcaggagggttgggtggagatgtttttagcagagcttccattagtgtagacctgtagccacctgtcagaaggtgggtggcatattggggacctgggaatgtgtgaaggaggagatcaaatttcagtggctttggacagaaaagaaggctctggatttaagcgggtggtcacctgtgagaccaggtctaccttgggactgttatttaactgaatcagttatttccttgaaatttcacagtagtgggtgggcctgttttaaggctctgacagataccacgaaacatgaagcacgtggaactacaagacccccggggtctttctgagtgcaaggctgaaatggacaagggctcctcacgggggtggagggagccggagcctgccttgtgttccttttttgacttgtgacatttttcaaacacataattaaaaggacttatgctctgctgtctcaggacataa

SEQ ID NO: 152306 - DNA, 568 bp, Homo sapiens
  Payload ID: 9965
  Gene Symbol: MED9
  Gene Name: mediator complex subunit 9
  ENST ID: ENST00000581315
  CDS Start-End: 18-266
aacctacccccggagccatggcctctgctggggtggcagccgggcgacaggcggaggatgtattgccgccaacgtccgaccagccgctgcctgacaccaagccgctgccgcctcctcagccgccgccggtccctgcgcctcaaccgcagcagtcgccggcgccacggcctcagtcacctgcccgcgcgagggaggaagagaactactcctttttacctttggttcacaacatcatcaaatgtagagacggggctggcctcaagtgatctgctgacttcagcctcccaaagtgctgggattacaggcgtgagccaccggccgccatctgggatttttaagcagcatagtgacctgctcagacttgggtttctaaagcatggacaaggacagcccggaggtccaccaggacctgaacgccctcaaaagcaagttccaggagatgcgcaagctcatcagcaccatgcccggcatccacctgagccccgaacagcagcagcagcagctgcagagcctccgggagcaagtcaggaccaagaatgagcttctgcaaaagtacaagagcctctgc

SEQ ID NO: 152307 - DNA, 565 bp, Homo sapiens
  Payload ID: 9965
  Gene Symbol: MED9
  Gene Name: mediator complex subunit 9
  ENST ID: ENST00000580462
  CDS Start-End: 49-297
cgcgacgcttttggcgacccgacctctggctaacctacccccggagccatggcctctgctggggtggcagccgggcgacaggcggaggatgtattgccgccaacgtccgaccagccgctgcctgacaccaagccgctgccgcctcctcagccgccgccggtccctgcgcctcaaccgcagcagtcgccggcgccacggcctcagtcacctgcccgcgcgagggaggaagagaactactcctttttacctttggttcacaacatcatcaaatgtagagacggggctggcctcaagtgatctgctgacttcagcctcccaaagtgctgggattacaggcgtgagccaccggccgccatctgggatttttaagcagcatagtgacctgctcagacttgggtttctaaaggtaggtggggcagaagtgtttcagaagaggggaggacctgggtccacaggaaggcagtggcaatgggaggtggctggtctagaggagatggagctggcaggatggtggctggaagaagggggcacacaggtgcaagcctgggggtcctagcgtggccag

SEQ ID NO: 152308 - DNA, 4505 bp, Homo sapiens
  Payload ID: 9966
  Gene Symbol: MEMO1
  Gene Name: mediator of cell motility 1
  Uniprot ID: Q9Y316
  ENST ID: ENST00000295065
  CDS Start-End: 311-1204
gggacgccgggggccggggccagggctttccgggcttcggtgaggccgccgtgggccccatcttccggcggtcgccggagtttgtggtgattgttgctgccgccgccaccgccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaatagtctgatttaaacttattgctctgtggtatatatgaaaattgttttttattaattccatctcagaatttttgttaaaaatggtaaacctcagctcttatgtaaaaatatattaggatgtattttatattttatatatttgtatgatttttttaaatcagaaattagaatcatatgatcttaaagttaactttttaaattacatgcagtttgcctttttgtctgtgacatccctttgtgtcattactatattgtaacagaatatatattcaagattggtaaaagaacgtagatgtaatccttgacttcaaagatcatgtttgatagtctgcaaatgaggaaacattgaagagtgttcttagtgtttttcaaatcattgcagaccttacactgctgtgcttttttaatgctttaagcagtttgactcttttacttgaatttttagccagagatcattaacatcatcaacaacaacaagccactggattttcttatggttacacaattttttttgtcatgatttttggtgcggctcttccaactaaaataatggtatgatgttgtatttctttctttctttagcatagaccaattctagtcactttcgccaaaaaaaaaaaaaaaaaaaaaaaaaagatataatttagttaataattcagttaccatgtatgtactgcattatacctattttaacctaacagtgtctacattatattagagagtgtttatatctccagtgttatgccagagtagcacaatttttagatgccttgcaccaattttatttaaagatttatgtttcttatttattaaatatcaactttctatactcgagtgaaataaaataatgttaccttttagattcaaagtcgcccacctatgtatgtgtggaaattatattcttacacattagtgatttattttccgtaatttagatacactttttagtactattaatatttatttcttgtttaatatgaactataaaattttaaaatggacaacagtgaatttttaaaataatgttttctgagtataagactaatacatgattattttagaaaatttgaaaattactgaaaagttataaagagaaaaaattatctgcaatctcactacccagagataaccctgttaatatttttctgtatttcttttcagtctttgtctgtgctatttctatgtatgagtgtgtatacatgtgtttgtgtgtgtgtgtaataacaaacttgagattatactgaccatatagttatgtaccctgttttttataacctaacttcatacatatttacccatgtctatgaaaatgtgacttttaaaaatggctgcctaatattctattgtatgaatatgccacaatttaactacttctctctttggatattaggttgttctaatctttcaccattataaataatagtgggatagacatccttgtttgtaaaatttcatctctatattagactctttaggatatactcatgtacatggaataagtggtttagacagtgagaactttttaggctctttaaaatatttccaagttataaccctttagaaagattgtactaaattaacaatgtatgagtacccatcattctgccccttcaccagtatcattatttttttaatctttgacagttggttaacataacaatcggttgtttctttgaccattctaataagagttgctttataatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggtggcggagcctgcagtgagccgagatcccgccactgcactccagcctgggcgacagagcgagactccgtctcaaaaaaaaaaaaaaaaaaaaaaaaaaagagttgctttataattaattatttttgtctttctataattttatagttgattgatttttaaaaagacaagagggttgcctaagttgggtggactatagtacaagtatggttcttgcacttttaaaactgtagaagctggacacgatggtatgcacctgtagtcccagctactttgactgtggaggcaggaggatcacttgacagtttgagaccagcctgggcaatgtagtgagccccccaaaaccctctaaacaaacaaacaaatctgcagaatatttcagcatcactctacactttcctagaatatcaacatacctgataatgaagtagaaagagttccaaattgatgattgagtgttgggttctagttctatttctgccactaattagttctctgaacttaagtgtttcatgtcatattgaaactttctcatttgtaaaatgtggaggggatctcttaagtgctttctagtttcaaagtactttgatactgtgactttattttgtagaggttctggtgtcatttatttttaatagctacatgaataatgtagagatactatcttttgatttcaacttcacatacatggaaatgaaagtcttgttatttaacacaaaaggaaatttaatttgcattatttaatgcagttaatattacctaaaatgttgaacttaagcttttctactttaagtgcctttaaaagttttgtatttggaatctaaaatataaaggaaattcttatgtagctcta

SEQ ID NO: 152309 - DNA, 1498 bp, Homo sapiens
  Payload ID: 9966
  Gene Symbol: MEMO1
  Gene Name: mediator of cell motility 1
  Uniprot ID: Q9Y316
  ENST ID: ENST00000379383
  CDS Start-End: 58-960
cctatctgtagatctgtttatcttcaatatagaaagagatttatttggaattgactcatgccattatggagggctgacaagtgccaagatgtgcagtcagcaagctggagacccaggagagctgacggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaa

SEQ ID NO: 152310 - DNA, 682 bp, Homo sapiens
  Payload ID: 9966
  Gene Symbol: MEMO1
  Gene Name: mediator of cell motility 1
  ENST ID: ENST00000407893
  CDS Start-End: 252-554
atcttccggcggtcgccggagtttgtggtgattgttgctgccgccgccaccgccccggctgccatctcctcctcctgggccgccgcctcctcctcttcctcctcctcctgggccgggctgatcccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacattttccaggagtgctctgatgttaaatatcctttctctctgtcttttcatattttcctcaatcagaaaaatgccctttctcattatttgattcttggttcatatactacctggccctagtcaggctacctaaacatttctgagttaccattctctatagcccacgtaagcctttaatttaaaacaaagtgtcatgttatttatgtgctattaagatag

SEQ ID NO: 152311 - DNA, 1482 bp, Homo sapiens
  Payload ID: 9966
  Gene Symbol: MEMO1
  Gene Name: mediator of cell motility 1
  Uniprot ID: Q9Y316
  ENST ID: ENST00000404530
  CDS Start-End: 51-944
atgctcagtgggcaggacccgttagagtggcgagcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaa

SEQ ID NO: 152312 - DNA, 1336 bp, Homo sapiens
  Payload ID: 9966
  Gene Symbol: MEMO1
  Gene Name: mediator of cell motility 1
  Uniprot ID: Q9Y316
  ENST ID: ENST00000426310
  CDS Start-End: 129-953
ccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaac

SEQ ID NO: 152313 - DNA, 315 bp, Homo sapiens
  Payload ID: 9966
  Gene Symbol: MEMO1
  Gene Name: mediator of cell motility 1
  ENST ID: ENST00000437854
  CDS Start-End: 255-315
gagaccttgggggtgcaaatcgatgagagatgcctgtatatgatggatacccgcgggactgtcctcgtggaaagccgcatccgcgagccctaggtgctctccatttgaggaagttggctgggggagggggcttgccttgcggctgcgtcctgctccccgcgccctgcccccacctcccagcctctgctgccgctaaaccccggagagcggagcgtgcacgttgagattcctcggcgggcggcacaggcaccaagatgtccaaccgagtggtctgccgagaagccagtcacgccgggagctggtacacagcctcag

SEQ ID NO: 152314 - DNA, 7576 bp, Homo sapiens
  Payload ID: 9967
  Gene Symbol: MDC1
  Gene Name: mediator of DNA-damage checkpoint 1
  Uniprot ID: Q14676
  ENST ID: ENST00000376406
  CDS Start-End: 649-6918
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 152315 - DNA, 7576 bp, Homo sapiens
  Payload ID: 9967
  Gene Symbol: MDC1
  Gene Name: mediator of DNA-damage checkpoint 1
  Uniprot ID: Q14676
  ENST ID: ENST00000383566
  CDS Start-End: 649-6918
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagaaggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 152316 - DNA, 7576 bp, Homo sapiens
  Payload ID: 9967
  Gene Symbol: MDC1
  Gene Name: mediator of DNA-damage checkpoint 1
  Uniprot ID: Q14676
  ENST ID: ENST00000427406
  CDS Start-End: 649-6918
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcgtctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 152317 - DNA, 582 bp, Homo sapiens
  Payload ID: 9967
  Gene Symbol: MDC1
  Gene Name: mediator of DNA-damage checkpoint 1
  ENST ID: ENST00000438165
  CDS Start-End: 203-582
attaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaaatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgct

SEQ ID NO: 152318 - DNA, 583 bp, Homo sapiens
  Payload ID: 9967
  Gene Symbol: MDC1
  Gene Name: mediator of DNA-damage checkpoint 1
  ENST ID: ENST00000437759
  CDS Start-End: 244-583
aatactcatccttacctggcgccccgctccgagtttaggtatgaagacacagggagacgtcgggccacaagggaacccactgaggtggggaccaaagatggtggctctttgaattggagccaagcgtggtgggcacccgctgagttggcctgtcataaagacggagttgacactttatccatggggcatcctactttccctacctgtcaacagtttccctctagagtggcatattttcagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcacc

SEQ ID NO: 152319 - DNA, 582 bp, Homo sapiens
  Payload ID: 9967
  Gene Symbol: MDC1
  Gene Name: mediator of DNA-damage checkpoint 1
  ENST ID: ENST00000424507
  CDS Start-End: 96-582
gtaccttgggtgcgactgggcggaggtgacttggaagttcgcttctcggactgtaatactcatccttacctggcgccccgctccgagtttagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttc

SEQ ID NO: 152320 - DNA, 583 bp, Homo sapiens; identical to SEQ ID NO: 152318
  Payload ID: 9967
  Gene Symbol: MDC1
  Gene Name: mediator of DNA-damage checkpoint 1
  ENST ID: ENST00000450033
  CDS Start-End: 244-583

SEQ ID NO: 152321 - DNA, 582 bp, Homo sapiens; identical to SEQ ID NO: 152319
  Payload ID: 9967
  Gene Symbol: MDC1
  Gene Name: mediator of DNA-damage checkpoint 1
  ENST ID: ENST00000441397
  CDS Start-End: 96-582

SEQ ID NO: 152322 - DNA, 583 bp, Homo sapiens; identical to SEQ ID NO: 152318
  Payload ID: 9967
  Gene Symbol: MDC1
  Gene Name: mediator of DNA-damage checkpoint 1
  ENST ID: ENST00000423726
  CDS Start-End: 244-583

SEQ ID NO: 152323 - DNA, 582 bp, Homo sapiens; identical to SEQ ID NO: 152319
  Payload ID: 9967
  Gene Symbol: MDC1
  Gene Name: mediator of DNA-damage checkpoint 1
  ENST ID: ENST00000431441
  CDS Start-End: 96-582

SEQ ID NO: 152324 - DNA, 582 bp, Homo sapiens; identical to SEQ ID NO: 152319
  Payload ID: 9967
  Gene Symbol: MDC1
  Gene Name: mediator of DNA-damage checkpoint 1
  ENST ID: ENST00000412395
  CDS Start-End: 96-582

SEQ ID NO: 152325 - DNA, 582 bp, Homo sapiens; identical to SEQ ID NO: 152317
  Payload ID: 9967
  Gene Symbol: MDC1
  Gene Name: mediator of DNA-damage checkpoint 1
  ENST ID: ENST00000445764
  CDS Start-End: 203-582

SEQ ID NO: 152326 - DNA, 583 bp, Homo sapiens
  Payload ID: 9967
  Gene Symbol: MDC1
  Gene Name: mediator of DNA-damage checkpoint 1
  ENST ID: ENST00000424638
  CDS Start-End: 244-583
aatactcatccttacctggcgccccgctccgagtttaggtatgaagacacagggagacgtcgggccacaagggaacccactgaggtggggaccaaagatggtggctctttgaattggagccaagcgtggtgggcacccgctgagttggcctgtcataaagacggagttgacactttatccatggggcatcctactttccctacctgtcaacaatttccctctagagtggcatattttcagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcacc

SEQ ID NO: 152327 - DNA, 916 bp, Homo sapiens
  Payload ID: 9967
  Gene Symbol: MDC1
  Gene Name: mediator of DNA-damage checkpoint 1
  ENST ID: ENST00000448895
  CDS Start-End: 1-916
acatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtcccc

SEQ ID NO: 152328 - DNA, 916 bp, Homo sapiens; identical to SEQ ID NO: 152327
  Payload ID: 9967
  Gene Symbol: MDC1
  Gene Name: mediator of DNA-damage checkpoint 1
  ENST ID: ENST00000445130
  CDS Start-End: 1-916

SEQ ID NO: 152329 - DNA, 582 bp, Homo sapiens; identical to SEQ ID NO: 152319
  Payload ID: 9967
  Gene Symbol: MDC1
  Gene Name: mediator of DNA-damage checkpoint 1
  ENST ID: ENST00000447640
  CDS Start-End: 96-582

SEQ ID NO: 152330 - DNA, 7576 bp, Homo sapiens
  Payload ID: 9967
  Gene Symbol: MDC1
  Gene Name: mediator of DNA-damage checkpoint 1
  Uniprot ID: Q14676
  ENST ID: ENST00000420019
  CDS Start-End: 649-6918
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 152331 - DNA, 582 bp, Homo sapiens
  Payload ID: 9967
  Gene Symbol: MDC1
  Gene Name: mediator of DNA-damage checkpoint 1
  ENST ID: ENST00000425072
  CDS Start-End: 203-582
attaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaaatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgct

SEQ ID NO: 152332 - DNA, 916 bp, Homo sapiens; identical to SEQ ID NO: 152327
  Payload ID: 9967
  Gene Symbol: MDC1
  Gene Name: mediator of DNA-damage checkpoint 1
  ENST ID: ENST00000425790
  CDS Start-End: 1-916

SEQ ID NO: 152333 - DNA, 582 bp, Homo sapiens; identical to SEQ ID NO: 152319
  Payload ID: 9967
  Gene Symbol: MDC1
  Gene Name: mediator of DNA-damage checkpoint 1
  ENST ID: ENST00000425029
  CDS Start-End: 96-582

SEQ ID NO: 152334 - DNA, 916 bp, Homo sapiens; identical to SEQ ID NO: 152327
  Payload ID: 9967
  Gene Symbol: MDC1
  Gene Name: mediator of DNA-damage checkpoint 1
  ENST ID: ENST00000419675
  CDS Start-End: 1-916

SEQ ID NO: 152335 - DNA, 582 bp, Homo sapiens; identical to SEQ ID NO: 152317
  Payload ID: 9967
  Gene Symbol: MDC1
  Gene Name: mediator of DNA-damage checkpoint 1
  ENST ID: ENST00000424437
  CDS Start-End: 203-582

SEQ ID NO: 152336 - DNA, 916 bp, Homo sapiens; identical to SEQ ID NO: 152327
  Payload ID: 9967
  Gene Symbol: MDC1
  Gene Name: mediator of DNA-damage checkpoint 1
  ENST ID: ENST00000419172
  CDS Start-End: 1-916

SEQ ID NO: 152337 - DNA, 582 bp, Homo sapiens; identical to SEQ ID NO: 152317
  Payload ID: 9967
  Gene Symbol: MDC1
  Gene Name: mediator of DNA-damage checkpoint 1
  ENST ID: ENST00000417228
  CDS Start-End: 203-582

SEQ ID NO: 152338 - DNA, 582 bp, Homo sapiens; identical to SEQ ID NO: 152319
  Payload ID: 9967
  Gene Symbol: MDC1
  Gene Name: mediator of DNA-damage checkpoint 1
  ENST ID: ENST00000416571
  CDS Start-End: 96-582

SEQ ID NO: 152339 - DNA, 7576 bp, Homo sapiens
  Payload ID: 9967
  Gene Symbol: MDC1
  Gene Name: mediator of DNA-damage checkpoint 1
  Uniprot ID: Q14676
  ENST ID: ENST00000435664
  CDS Start-End: 649-6918
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgcgctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 152340 - DNA, 582 bp, Homo sapiens; identical to SEQ ID NO: 152317
  Payload ID: 9967
  Gene Symbol: MDC1
  Gene Name: mediator of DNA-damage checkpoint 1
  ENST ID: ENST00000455729
  CDS Start-End: 203-582

SEQ ID NO: 152341 - DNA, 583 bp, Homo sapiens; identical to SEQ ID NO: 152318
  Payload ID: 9967
  Gene Symbol: MDC1
  Gene Name: mediator of DNA-damage checkpoint 1
  ENST ID: ENST00000456589
  CDS Start-End: 244-583

SEQ ID NO: 152342 - DNA, 916 bp, Homo sapiens; identical to SEQ ID NO: 152327
  Payload ID: 9967
  Gene Symbol: MDC1
  Gene Name: mediator of DNA-damage checkpoint 1
  ENST ID: ENST00000447192
  CDS Start-End: 1-916

SEQ ID NO: 152343 - DNA, 582 bp, Homo sapiens; identical to SEQ ID NO: 152317
  Payload ID: 9967
  Gene Symbol: MDC1
  Gene Name: mediator of DNA-damage checkpoint 1
  ENST ID: ENST00000432998
  CDS Start-End: 203-582

SEQ ID NO: 152344 - DNA, 582 bp, Homo sapiens; identical to SEQ ID NO: 152319
  Payload ID: 9967
  Gene Symbol: MDC1
  Gene Name: mediator of DNA-damage checkpoint 1
  ENST ID: ENST00000422195
  CDS Start-End: 96-582

SEQ ID NO: 152345 - DNA, 583 bp, Homo sapiens; identical to SEQ ID NO: 152318
  Payload ID: 9967
  Gene Symbol: MDC1
  Gene Name: mediator of DNA-damage checkpoint 1
  ENST ID: ENST00000413973
  CDS Start-End: 244-583

SEQ ID NO: 152346 - DNA, 916 bp, Homo sapiens; identical to SEQ ID NO: 152327
  Payload ID: 9967
  Gene Symbol: MDC1
  Gene Name: mediator of DNA-damage checkpoint 1
  ENST ID: ENST00000417033
  CDS Start-End: 1-916

SEQ ID NO: 152347 - DNA, 7576 bp, Homo sapiens; identical to SEQ ID NO: 152330
  Payload ID: 9967
  Gene Symbol: MDC1
  Gene Name: mediator of DNA-damage checkpoint 1
  Uniprot ID: Q14676
  ENST ID: ENST00000449153
  CDS Start-End: 649-6918

SEQ ID NO: 152348 - DNA, 582 bp, Homo sapiens; identical to SEQ ID NO: 152317
  Payload ID: 9967
  Gene Symbol: MDC1
  Gene Name: mediator of DNA-damage checkpoint 1
  ENST ID: ENST00000416368
  CDS Start-End: 203-582

SEQ ID NO: 152349 - DNA, 583 bp, Homo sapiens; identical to SEQ ID NO: 152318
  Payload ID: 9967
  Gene Symbol: MDC1
  Gene Name: mediator of DNA-damage checkpoint 1
  ENST ID: ENST00000422266
  CDS Start-End: 244-583

SEQ ID NO: 152350 - DNA, 916 bp, Homo sapiens; identical to SEQ ID NO: 152327
  Payload ID: 9967
  Gene Symbol: MDC1
  Gene Name: mediator of DNA-damage checkpoint 1
  ENST ID: ENST00000444412
  CDS Start-End: 1-916

SEQ ID NO: 152351 - DNA, 583 bp, Homo sapiens; identical to SEQ ID NO: 152318
  Payload ID: 9967
  Gene Symbol: MDC1
  Gene Name: mediator of DNA-damage checkpoint 1
  ENST ID: ENST00000430358
  CDS Start-End: 244-583

SEQ ID NO: 152352 - DNA, 7576 bp, Homo sapiens; identical to SEQ ID NO: 152330
  Payload ID: 9967
  Gene Symbol: MDC1
  Gene Name: mediator of DNA-damage checkpoint 1
  Uniprot ID: Q14676
  ENST ID: ENST00000440369
  CDS Start-End: 649-6918

SEQ ID NO: 152353 - DNA, 7576 bp, Homo sapiens; identical to SEQ ID NO: 152316
  Payload ID: 9967
  Gene Symbol: MDC1
  Gene Name: mediator of DNA-damage checkpoint 1
  Uniprot ID: Q14676
  ENST ID: ENST00000420320
  CDS Start-End: 649-6918

SEQ ID NO: 152354 - DNA, 830 bp, Homo sapiens
  Payload ID: 9967
  Gene Symbol: MDC1
  Gene Name: mediator of DNA-damage checkpoint 1
  ENST ID: ENST00000552474
  CDS Start-End: 198-626
acacagggagacgtcgggccacaagggaacccactgaggtggggaccaaagatggtggctctttgaattggagccaagcgtggtgggcacccgctgagttggcctgtcataaagacggagttgacactttatccatggggcatcctactttccctacctgtcaacagtttccctctagagtggcatattttcagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatgtaccatcgcctggatgtctctctgccctttgtctcccggggccctctgacagtagaagagacacccagagtacagggagaaactcaaccccagaggcttctgttggcggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggc

SEQ ID NO: 152355 - DNA, 830 bp, Homo sapiens; identical to SEQ ID NO: 152354
  Payload ID: 9967
  Gene Symbol: MDC1
  Gene Name: mediator of DNA-damage checkpoint 1
  ENST ID: ENST00000547681
  CDS Start-End: 198-626

SEQ ID NO: 152356 - DNA, 830 bp, Homo sapiens; identical to SEQ ID NO: 152354
  Payload ID: 9967
  Gene Symbol: MDC1
  Gene Name: mediator of DNA-damage checkpoint 1
  ENST ID: ENST00000547353
  CDS Start-End: 198-626

SEQ ID NO: 152357 - DNA, 830 bp, Homo sapiens; identical to SEQ ID NO: 152354
  Payload ID: 9967
  Gene Symbol: MDC1
  Gene Name: mediator of DNA-damage checkpoint 1
  ENST ID: ENST00000550688
  CDS Start-End: 198-626

SEQ ID NO: 152358 - DNA, 830 bp, Homo sapiens; identical to SEQ ID NO: 152354
  Payload ID: 9967
  Gene Symbol: MDC1
  Gene Name: mediator of DNA-damage checkpoint 1
  ENST ID: ENST00000546539
  CDS Start-End: 198-626

SEQ ID NO: 152359 - DNA, 830 bp, Homo sapiens; identical to SEQ ID NO: 152354
  Payload ID: 9967
  Gene Symbol: MDC1
  Gene Name: mediator of DNA-damage checkpoint 1
  ENST ID: ENST00000552522
  CDS Start-End: 198-626

SEQ ID NO: 152360 - DNA, 830 bp, Homo sapiens
  Payload ID: 9967
  Gene Symbol: MDC1
  Gene Name: mediator of DNA-damage checkpoint 1
  ENST ID: ENST00000550500
  CDS Start-End: 198-626
acacagggagacgtcgggccacaagggaacccactgaggtggggaccaaagatggtggctctttgaattggagccaagcgtggtgggcacccgctgagttggcctgtcataaagacggagttgacactttatccatggggcatcctactttccctacctgtcaacaatttccctctagagtggcatattttcagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatgtaccatcgcctggatgtctctctgccctttgtctcccggggccctctgacagtagaagagacacccagagtacagggagaaactcaaccccagaggcttctgttggcggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggc

SEQ ID NO: 152361 - DNA, 830 bp, Homo sapiens; identical to SEQ ID NO: 152354
  Payload ID: 9967
  Gene Symbol: MDC1
  Gene Name: mediator of DNA-damage checkpoint 1
  ENST ID: ENST00000613547
  CDS Start-End: 198-626

SEQ ID NO: 152362 - DNA, 3499 bp, Homo sapiens
  Payload ID: 9968
  Gene Symbol: MEFV
  Gene Name: Mediterranean fever
  Uniprot ID: O15553
  ENST ID: ENST00000219596
  CDS Start-End: 41-2386
gaagccagacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcaggaatattccacacaagaaaacggcacagatgattccgcagcgtccagctccctgggggagaacaagcccaggagcctgaagactccagaccaccccgaggggaacgaggggaacggccctcggccgtacgggggcggagctgccagcctgcggtgcagccagcccgaggccgggagggggctgtcgaggaagcccctgagcaaacgcagagagaaggcctcggagggcctggacgcgcagggcaagcctcggacccggagcccggccctgccgggcgggagaagccccggcccctgcagggcgctagaggggggccaggccgaggtccggctgcgcagaaacgccagctccgcggggaggctgcaggggctggcggggggcgccccggggcagaaggagtgcaggcccttcgaagtgtacctgccctcgggaaagatgcgacctagaagccttgaggtcaccatttctacaggggagaaggcgcccgcaaatccagaaattctcctgactctagaggaaaagacagctgcgaatctggactcggcaacagaaccccgggcaaggcccactccggatggaggggcatctgcggacctgaaggaaggccctggaaatccagaacattcggtcaccggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactgaatgcccaacactgcatctctcttcctgcttctggccttgtatcttgcattcacactcaatagtcacggaatgccgactaggtgctagctgctatgggaaatgcaaaaataacaaaatagttactgtgcccacggagcctacccgattatagcagaggtaagttaggaacgaacatgttagtcaatccgggtgaagacatgtactgatgacacaccatggatttcagaggaggaagtacggagtcgttgcataatccgcccctggtgggtggcactctcaggtgctcctgaacagaagatttggccctcattttccctcagaaccccacggcaaggatatatgtccccttgttctctctgcttctgtcttgaggatatgggaagcctagagaaacgcaagcagactggattgggatagaagtatttgtgtacctggattaatgaactatgattttttttttttttttttgagaccaaatcttgctctgtggcccaggctggagtgcagtggcacgatctcagctcactgcaacctccacctcccaggttcaagcgattctcctgcctcagcctcctgagcagctgggattacaggtgcgtgccaccacaccaggctggttttcttgtatttttagtagagacgggggtttcaccatgttagccaggctggtctcgaactcctgacctcaggtgatccacccgcctcagcctcccaaagtgctgggattacaggcatgagccactgtgcccggcctatgattcttttttttttttttttttgagacaaagttttgctcttgtcacccaggctggagtgcagtggtgcaatcttggctcgcaacctccgcctcccaggttcaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgccgggccatgattcttaagagaattgactgggcctcatgaataaaaaaattagaaaatct

SEQ ID NO: 152363 - DNA, 2959 bp, Homo sapiens
  Payload ID: 9968
  Gene Symbol: MEFV
  Gene Name: Mediterranean fever
  ENST ID: ENST00000339854
  CDS Start-End: 41-1846
gaagccagacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcaggatatggggtcttgctatgttgcccaggttggtctcgaactcctgatctcaaacaatcctcccatctttgcctccgaaactgctgggattacaggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactgaatgcccaacactgcatctctcttcctgcttctggccttgtatcttgcattcacactcaatagtcacggaatgccgactaggtgctagctgctatgggaaatgcaaaaataacaaaatagttactgtgcccacggagcctacccgattatagcagaggtaagttaggaacgaacatgttagtcaatccgggtgaagacatgtactgatgacacaccatggatttcagaggaggaagtacggagtcgttgcataatccgcccctggtgggtggcactctcaggtgctcctgaacagaagatttggccctcattttccctcagaaccccacggcaaggatatatgtccccttgttctctctgcttctgtcttgaggatatgggaagcctagagaaacgcaagcagactggattgggatagaagtatttgtgtacctggattaatgaactatgattttttttttttttttttgagaccaaatcttgctctgtggcccaggctggagtgcagtggcacgatctcagctcactgcaacctccacctcccaggttcaagcgattctcctgcctcagcctcctgagcagctgggattacaggtgcgtgccaccacaccaggctggttttcttgtatttttagtagagacgggggtttcaccatgttagccaggctggtctcgaactcctgacctcaggtgatccacccgcctcagcctcccaaagtgctgggattacaggcatgagccactgtgcccggcctatgattcttttttttttttttttttgagacaaagttttgctcttgtcacccaggctggagtgcagtggtgcaatcttggctcgcaacctccgcctcccaggttcaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgccgggccatgattcttaagagaattgactgggcctcatgaataaaaaaattagaaaatct

SEQ ID NO: 152364 - DNA, 3597 bp, Homo sapiens
  Payload ID: 9968
  Gene Symbol: MEFV
  Gene Name: Mediterranean fever
  ENST ID: ENST00000538326
  CDS Start-End: 41-1513
gaagccagacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcaggaatattccacacaagaaaacggcacagatgattccgcagcgtccagctccctgggggagaacaagcccaggagcctgaagactccagaccaccccgaggggaacgaggggaacggccctcggccgtacgggggcggagctgccagcctgcggtgcagccagcccgaggccgggagggggctgtcgaggaagcccctgagcaaacgcagagagaaggcctcggagggcctggacgcgcagggcaagcctcggacccggagcccggccctgccgggcgggagaagccccggcccctgcagggcgctagaggggggccaggccgaggtccggctgcgcagaaacgccagctccgcggggaggctgcaggggctggcggggggcgccccggggcagaaggagtgcaggcccttcgaagtgtacctgccctcgggaaagatgcgacctagaagccttgaggtcaccatttctacaggggagaaggcgcccgcaaatccagaaattctcctgactctagaggaaaagacagctgcgaatctggactcggcaacagaaccccgggcaaggcccactccggatggaggggcatctgcggacctgaaggaaggccctggaaatccagaacattcggtcaccggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctggttgtagtgcagtggtgtgatcttggctcactgcaacctctgcctcccgggttcaagcgattctcctgcctcagcctcctgagtagctgggattatagaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactgaatgcccaacactgcatctctcttcctgcttctggccttgtatcttgcattcacactcaatagtcacggaatgccgactaggtgctagctgctatgggaaatgcaaaaataacaaaatagttactgtgcccacggagcctacccgattatagcagaggtaagttaggaacgaacatgttagtcaatccgggtgaagacatgtactgatgacacaccatggatttcagaggaggaagtacggagtcgttgcataatccgcccctggtgggtggcactctcaggtgctcctgaacagaagatttggccctcattttccctcagaaccccacggcaaggatatatgtccccttgttctctctgcttctgtcttgaggatatgggaagcctagagaaacgcaagcagactggattgggatagaagtatttgtgtacctggattaatgaactatgattttttttttttttttttgagaccaaatcttgctctgtggcccaggctggagtgcagtggcacgatctcagctcactgcaacctccacctcccaggttcaagcgattctcctgcctcagcctcctgagcagctgggattacaggtgcgtgccaccacaccaggctggttttcttgtatttttagtagagacgggggtttcaccatgttagccaggctggtctcgaactcctgacctcaggtgatccacccgcctcagcctcccaaagtgctgggattacaggcatgagccactgtgcccggcctatgattcttttttttttttttttttgagacaaagttttgctcttgtcacccaggctggagtgcagtggtgcaatcttggctcgcaacctccgcctcccaggttcaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgccgggccatgattcttaagagaattgactgggcctcatgaataaaaaaattagaaaatct

SEQ ID NO: 152365 - DNA, 3617 bp, Homo sapiens
  Payload ID: 9968
  Gene Symbol: MEFV
  Gene Name: Mediterranean fever
  ENST ID: ENST00000537682
  CDS Start-End: 41-1882
gaagccagacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcaggaatattccacacaagaaaacggcacagatgattccgcagcgtccagctccctgggggagaacaagcccaggagcctgaagactccagaccaccccgaggggaacgaggggaacggccctcggccgtacgggggcggagctgccagcctgcggtgcagccagcccgaggccgggagggggctgtcgaggaagcccctgagcaaacgcagagagaaggcctcggagggcctggacgcgcagggcaagcctcggacccggagcccggccctgccgggcgggagaagccccggcccctgcagggcgctagaggggggccaggccgaggtccggctgcgcagaaacgccagctccgcggggaggctgcaggggctggcggggggcgccccggggcagaaggagtgcaggcccttcgaagtgtacctgccctcgggaaagatgcgacctagaagccttgaggtcaccatttctacaggggagaaggcgcccgcaaatccagaaattctcctgactctagaggaaaagacagctgcgaatctggactcggcaacagaaccccgggcaaggcccactccggatggaggggcatctgcggacctgaaggaaggccctggaaatccagaacattcggtcaccggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatggtgagtccagcggtaatggtgtgtgctggcctggggttgttgcagtgttcccttgtgctgttgacttgaggggccctatttagaagacaaaaaaaaaaaccaaacacctggagcaaagttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactgaatgcccaacactgcatctctcttcctgcttctggccttgtatcttgcattcacactcaatagtcacggaatgccgactaggtgctagctgctatgggaaatgcaaaaataacaaaatagttactgtgcccacggagcctacccgattatagcagaggtaagttaggaacgaacatgttagtcaatccgggtgaagacatgtactgatgacacaccatggatttcagaggaggaagtacggagtcgttgcataatccgcccctggtgggtggcactctcaggtgctcctgaacagaagatttggccctcattttccctcagaaccccacggcaaggatatatgtccccttgttctctctgcttctgtcttgaggatatgggaagcctagagaaacgcaagcagactggattgggatagaagtatttgtgtacctggattaatgaactatgattttttttttttttttttgagaccaaatcttgctctgtggcccaggctggagtgcagtggcacgatctcagctcactgcaacctccacctcccaggttcaagcgattctcctgcctcagcctcctgagcagctgggattacaggtgcgtgccaccacaccaggctggttttcttgtatttttagtagagacgggggtttcaccatgttagccaggctggtctcgaactcctgacctcaggtgatccacccgcctcagcctcccaaagtgctgggattacaggcatgagccactgtgcccggcctatgattcttttttttttttttttttgagacaaagttttgctcttgtcacccaggctggagtgcagtggtgcaatcttggctcgcaacctccgcctcccaggttcaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgccgggccatgattcttaagagaattgactgggcctcatgaataaaaaaattagaaaatct

SEQ ID NO: 152366 - DNA, 1888 bp, Homo sapiens
  Payload ID: 9968
  Gene Symbol: MEFV
  Gene Name: Mediterranean fever
  Uniprot ID: O15553
  ENST ID: ENST00000541159
  CDS Start-End: 1-1338
atggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcagggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgaccacagtccccaacatggcctgggttcctgggaggaacgggattatacccaacatagcatgcagggccctaagcagggggttccttgtctttccttgttgtcaggacagtgtaatttagcccctcttaatgctaatgctcaggatttttttccctatctgatttttctccgtagttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactga

SEQ ID NO: 152367 - DNA, 2984 bp, Homo sapiens
  Payload ID: 9968
  Gene Symbol: MEFV
  Gene Name: Mediterranean fever
  ENST ID: ENST00000536980
  CDS Start-End: 41-1249
gaagccagacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcagggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatggtgagtccagcggtaatggtgtgtgctggcctggggttgttgcagtgttcccttgtgctgttgacttgaggggccctatttagaagacaaaaaaaaaaaccaaacacctggagcaaagttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactgaatgcccaacactgcatctctcttcctgcttctggccttgtatcttgcattcacactcaatagtcacggaatgccgactaggtgctagctgctatgggaaatgcaaaaataacaaaatagttactgtgcccacggagcctacccgattatagcagaggtaagttaggaacgaacatgttagtcaatccgggtgaagacatgtactgatgacacaccatggatttcagaggaggaagtacggagtcgttgcataatccgcccctggtgggtggcactctcaggtgctcctgaacagaagatttggccctcattttccctcagaaccccacggcaaggatatatgtccccttgttctctctgcttctgtcttgaggatatgggaagcctagagaaacgcaagcagactggattgggatagaagtatttgtgtacctggattaatgaactatgattttttttttttttttttgagaccaaatcttgctctgtggcccaggctggagtgcagtggcacgatctcagctcactgcaacctccacctcccaggttcaagcgattctcctgcctcagcctcctgagcagctgggattacaggtgcgtgccaccacaccaggctggttttcttgtatttttagtagagacgggggtttcaccatgttagccaggctggtctcgaactcctgacctcaggtgatccacccgcctcagcctcccaaagtgctgggattacaggcatgagccactgtgcccggcctatgattcttttttttttttttttttgagacaaagttttgctcttgtcacccaggctggagtgcagtggtgcaatcttggctcgcaacctccgcctcccaggttcaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgccgggccatgattcttaagagaattgactgggcctcatgaataaaaaaattagaaaatct

SEQ ID NO: 152368 - DNA, 1267 bp, Homo sapiens
  Payload ID: 9968
  Gene Symbol: MEFV
  Gene Name: Mediterranean fever
  ENST ID: ENST00000539145
  CDS Start-End: 1-288
atggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcaggaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactga

SEQ ID NO: 152369 - DNA, 3710 bp, Homo sapiens
  Payload ID: 9968
  Gene Symbol: MEFV
  Gene Name: Mediterranean fever
  ENST ID: ENST00000542898
  CDS Start-End: 41-1975
gaagccagacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcaggaatattccacacaagaaaacggcacagatgattccgcagcgtccagctccctgggggagaacaagcccaggagcctgaagactccagaccaccccgaggggaacgaggggaacggccctcggccgtacgggggcggagctgccagcctgcggtgcagccagcccgaggccgggagggggctgtcgaggaagcccctgagcaaacgcagagagaaggcctcggagggcctggacgcgcagggcaagcctcggacccggagcccggccctgccgggcgggagaagccccggcccctgcagggcgctagaggggggccaggccgaggtccggctgcgcagaaacgccagctccgcggggaggctgcaggggctggcggggggcgccccggggcagaaggagtgcaggcccttcgaagtgtacctgccctcgggaaagatgcgacctagaagccttgaggtcaccatttctacaggggagaaggcgcccgcaaatccagaaattctcctgactctagaggaaaagacagctgcgaatctggactcggcaacagaaccccgggcaaggcccactccggatggaggggcatctgcggacctgaaggaaggccctggaaatccagaacattcggtcaccgatatggggtcttgctatgttgcccaggttggtctcgaactcctgatctcaaacaatcctcccatctttgcctccgaaactgctgggattacaggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatggtgagtccagcggtaatggtgtgtgctggcctggggttgttgcagtgttcccttgtgctgttgacttgaggggccctatttagaagacaaaaaaaaaaaccaaacacctggagcaaagttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactgaatgcccaacactgcatctctcttcctgcttctggccttgtatcttgcattcacactcaatagtcacggaatgccgactaggtgctagctgctatgggaaatgcaaaaataacaaaatagttactgtgcccacggagcctacccgattatagcagaggtaagttaggaacgaacatgttagtcaatccgggtgaagacatgtactgatgacacaccatggatttcagaggaggaagtacggagtcgttgcataatccgcccctggtgggtggcactctcaggtgctcctgaacagaagatttggccctcattttccctcagaaccccacggcaaggatatatgtccccttgttctctctgcttctgtcttgaggatatgggaagcctagagaaacgcaagcagactggattgggatagaagtatttgtgtacctggattaatgaactatgattttttttttttttttttgagaccaaatcttgctctgtggcccaggctggagtgcagtggcacgatctcagctcactgcaacctccacctcccaggttcaagcgattctcctgcctcagcctcctgagcagctgggattacaggtgcgtgccaccacaccaggctggttttcttgtatttttagtagagacgggggtttcaccatgttagccaggctggtctcgaactcctgacctcaggtgatccacccgcctcagcctcccaaagtgctgggattacaggcatgagccactgtgcccggcctatgattcttttttttttttttttttgagacaaagttttgctcttgtcacccaggctggagtgcagtggtgcaatcttggctcgcaacctccgcctcccaggttcaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgccgggccatgattcttaagagaattgactgggcctcatgaataaaaaaattagaaaatct

SEQ ID NO: 152370 - DNA, 1713 bp, Homo sapiens
  Payload ID: 9968
  Gene Symbol: MEFV
  Gene Name: Mediterranean fever
  Uniprot ID: O15553
  ENST ID: ENST00000536379
  CDS Start-End: 1-1713
atggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcagggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactga

SEQ ID NO: 152371 - DNA, 1751 bp, Homo sapiens
  Payload ID: 9968
  Gene Symbol: MEFV
  Gene Name: Mediterranean fever
  ENST ID: ENST00000570511
  CDS Start-End: 1-921
atggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcaggaatattccacacaagaaaacggcacagatgattccgcagcgtccagctccctgggggagaacaagcccaggagcctgaagactccagaccaccccgaggggaacgaggggaacggccctcggccgtacgggggcggagctgccagcctgcggtgcagccagcccgaggccgggagggggctgtcgaggaagcccctgagcaaacgcagagagaaggcctcggagggcctggacgcgcagggcaagcctcggacccggagcccggccctgccgggcgggagaagccccggcccctgcagggcgctagaggggggccaggccgaggtccggctgcgcagaaacgccagctccgcggggaggctgcaggggctggcggggggcgccccggggcagaaggagtgcaggcccttcgaagtgtacctgccctcgggaaagatgcgacctagaagccttgaggtcaccatttctacaggggagaaggcgcccgcaaatccagaaattctcctgactctagaggaaaagacagctgcgaatctggactcggcaacagaaccccgggcaaggcccactccggatggaggggcatctgcggacctgaaggaaggccctggaaatccagaacattcggtcaccgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactga

SEQ ID NO: 152372 - DNA, 1118 bp, Homo sapiens
  Payload ID: 9968
  Gene Symbol: MEFV
  Gene Name: Mediterranean fever
  ENST ID: ENST00000574583
  CDS Start-End: 1-288
atggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcaggaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactga

SEQ ID NO: 152373 - DNA, 1151 bp, Homo sapiens
  Payload ID: 9968
  Gene Symbol: MEFV
  Gene Name: Mediterranean fever
  ENST ID: ENST00000576315
  CDS Start-End: 1-288
atggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcaggaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagaaaccctgcgttcagaaatggaaatgttcaatgttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactga

SEQ ID NO: 152374 - DNA, 1036 bp, Homo sapiens
  Payload ID: 9968
  Gene Symbol: MEFV
  Gene Name: Mediterranean fever
  ENST ID: ENST00000572244
  CDS Start-End: 1-306
atggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcagggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactga

SEQ ID NO: 152375 - DNA, 1883 bp, Homo sapiens
  Payload ID: 9968
  Gene Symbol: MEFV
  Gene Name: Mediterranean fever
  ENST ID: ENST00000621655
  CDS Start-End: 1-1236
atggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcagggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgaccacagtccccaacatggcctgggttcctgggaggaacgggattatacccaacatagcatgcagggccctaagcagggggttccttgtcttgttgtcaggacagtgtaatttagcccctcttaatgctaatgctcaggatttttttccctatctgatttttctccgtagttccggagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactga

SEQ ID NO: 152376 - DNA, 1837 bp, Homo sapiens
  Payload ID: 9969
  Gene Symbol: MAMSTR
  Gene Name: MEF2 activating motif and SAP domain containing transcriptional regulator
  Uniprot ID: Q6ZN01
  ENST ID: ENST00000318083
  CDS Start-End: 65-1312
agactcaacccgccccagagcacagcttcgccgagcccacctggtccccatcccggccttggcaatgaccctggcggcttcctcccagcgttcccaaatcattcgctccaagttccgatctgtcctccagcttcggatccacagacggaatcaggagcagatctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggatgaagccctctcccctcactccctgcccaccaggagtccctagcccctcgccccccccacacaagttggaacttcagacccttaaactggaggagctgacggtctcagagctccggcagcagctgcgcctgcggggcctcccagtgtcggggaccaagtctatgctcctggagcgcatgcgcggcggcgcgccgccccgcgagcggccgaagccgcggcgcgaggacagtcccgcgggtgctccctggccgcgcctcaagcccaaggccctggcagccgcccggcgtcagggctcggtcaagcccagcgcagcatctcacaggccacctcttccacgtgccgcggataccccggggacggctccggctccaactcccactccggctcctgctgcagctccagccctgaccccttcctcagggccgggctcagcggctctgactctggaggaggagctgcaggaagcgatccggagggcgcagttgcttcctaaccggggcatcgatgacatcctggaggatcaggtggagcctgatgaccccctgccccctattcccctggacttccctggctccttcgacgtgctgtccccctccccggactctgaaggcctctcatctgttttctcctcttcactcccgtctcccacgaactcctcctccccttctcccagggaccccacggactccctggactggctggaggccctgagcgggggtcctcctctgggttctggtcccccaccccccagcatcttctccgctgacttatctgactccagcagcagccggctgtgggacctgctggaggatccatggtgatggattctaggatttacagagacagagaactgatgggggtggagagaagctccttgtgggaggagagggaactaccagcagagcccctcctaccgcagacacaggatcggagacaacctccaaccccacctgcctcctgaagtgctgctgacatgcaactgccttaactttgcctacctggcctccttatgatccccctccggcgtggtatggttggggggcttcttttgctgctggccacggcaaacaagctgcttgctgcttccttcagagacctcatggatgttcttacatgcccccgaccccggtagatggctccctgttgtttggggagcctggaaggtggttatgccttttggatgcaggagaggagcaagaaagagtggagagggagaatgggggagccggaccctgacctccctgggttctggttggagatgaaaaaattagaagcatcaggtctaagatcagcttctcttggaagcagagcctgagacaagatataaatgccagtcatttattaaa

SEQ ID NO: 152377 - DNA, 1825 bp, Homo sapiens
  Payload ID: 9969
  Gene Symbol: MAMSTR
  Gene Name: MEF2 activating motif and SAP domain containing transcriptional regulator
  Uniprot ID: Q6ZN01
  ENST ID: ENST00000356751
  CDS Start-End: 616-1554
gaatggcgctggcccgcggcgctgcgctggcagggagcaggcgggaggcccgaggaagggagcctgctgcccgcccacccgcctgcacaggctgtgtaagggggctgggcacgcatatcccgccaacaactgcagctcccaccagcctgccaggccaggctcctggacactcccttcccgccttcctcctcccacctccctcctccctccacagtcctccagcttcggatccacagacggaatcaggagcagaatccagttcaggcgcccatctcccagcaatcaagtcttgctccctggcctgccctccggcaccctggagccccgctttccacacagccttgctcctcccggcctggcttgctgcctgcaggcctctcagggtccttcaccgtctctccagtctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggatgaagccctctcccctcactccctgcccaccaggagtccctagcccctcgccccccccacacaagttggaacttcagacccttaaactggaggagctgacggtctcagagctccggcagcagctgcgcctgcggggcctcccagtgtcggggaccaagtctatgctcctggagcgcatgcgcggcggcgcgccgccccgcgagcggccgaagccgcggcgcgaggacagtcccgcgggtgctccctggccgcgcctcaagcccaaggccctggcagccgcccggcgtcagggctcggtcaagcccagcgcagcatctcacaggccacctcttccacgtgccgcggataccccggggacggctccggctccaactcccactccggctcctgctgcagctccagccctgaccccttcctcagggccgggctcagcggctctgactctggaggaggagctgcaggaagcgatccggagggcgcagttgcttcctaaccggggcatcgatgacatcctggaggatcaggtggagcctgatgaccccctgccccctattcccctggacttccctggctccttcgacgtgctgtccccctccccggactctgaaggcctctcatctgttttctcctcttcactcccgtctcccacgaactcctcctccccttctcccagggaccccacggactccctggactggctggaggccctgagcgggggtcctcctctgggttctggtcccccaccccccagcatcttctccgctgacttatctgactccagcagcagccggctgtgggacctgctggaggatccatggtgatggattctaggatttacagagacagagaactgatgggggtggagagaagctccttgtgggaggagagggaactaccagcagagcccctcctaccgcagacacaggatcggagacaacctccaaccccacctgcctcctgaagtgctgctgacatgcaactgccttaactttgcctacctggcctccttatgatccccctccggcgtggtatggttggggggcttcttttgctgctggccacggcaaacaagctgcttgctgcttccttcag

SEQ ID NO: 152378 - DNA, 415 bp, Homo sapiens
  Payload ID: 9969
  Gene Symbol: MAMSTR
  Gene Name: MEF2 activating motif and SAP domain containing transcriptional regulator
  ENST ID: ENST00000595591
  CDS Start-End: 382-415
atatcccgccaacaactgcagctcccaccagcctgccaggccaggctcctggacactcccttcccgccttcctcctcccacctccctcctccctccacagtcctccagcttcggatccacagacggaatcaggagcagagcctctcagggtccttcaccgtctctccagtctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcgg

SEQ ID NO: 152379 - DNA, 714 bp, Homo sapiens
  Payload ID: 9969
  Gene Symbol: MAMSTR
  Gene Name: MEF2 activating motif and SAP domain containing transcriptional regulator
  ENST ID: ENST00000599703
  CDS Start-End: 57-714
cccgccccagagcacagcttcgccgagcccacctggtccccatcccggccttggcaatgaccctggcggcttcctcccagcgttcccaaatcattcgctccaagttccgatctgtcctccagcttcggatccacagacggaatcaggagcagaatccagttcaggcgcccatctcccagcaatcaagtcttgctccctggcctgccctccggcaccctggagccccgctttccacacagccttgctcctcccggcctggcttgctgcctgcaggcctctcagggtccttcaccgtctctccagtctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggatgaagccctctcccctcactccctgcccaccaggagtccctagcccctcgccccccccacacaagttggaacttcagaccc

SEQ ID NO: 152380 - DNA, 1693 bp, Homo sapiens
  Payload ID: 9969
  Gene Symbol: MAMSTR
  Gene Name: MEF2 activating motif and SAP domain containing transcriptional regulator
  Uniprot ID: Q6ZN01
  ENST ID: ENST00000594582
  CDS Start-End: 680-1423
gggggcaggtggagccgggggcagggctgcctccagcctgcacgctggctggctcgtagccccagaatggcgctggcccgcggcgctgcgctggcagggagcaggcgggaggcccgaggaagggagcctgctgcccgcccacccgcctgcacaggctgtgtaagggggctgggcacgcatatcccgccaacaactgcagctcccaccagcctgccaggccaggctcctggacactcccttcccgccttcctcctcccacctccctcctccctccacagtcctccagcttcggatccacagacggaatcaggagcagaatccagttcaggcgcccatctcccagcaatcaagtcttgctccctggcctgccctccggcaccctggagccccgctttccacacagccttgctcctcccggcctggcttgctgcctgcaggcctctcagggtccttcaccgtctctccagtctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggatgaagccctctcccctcactccctgcccaccaggagtccctagcccctcgccccccccacacaagttggaacttcagacccttaaactggaggagctgacggtcaagcccagcgcagcatctcacaggccacctcttccacgtgccgcggataccccggggacggctccggctccaactcccactccggctcctgctgcagctccagccctgaccccttcctcagggccgggctcagcggctctgactctggaggaggagctgcaggaagcgatccggagggcgcagttgcttcctaaccggggcatcgatgacatcctggaggatcaggtggagcctgatgaccccctgccccctattcccctggacttccctggctccttcgacgtgctgtccccctccccggactctgaaggcctctcatctgttttctcctcttcactcccgtctcccacgaactcctcctccccttctcccagggaccccacggactccctggactggctggaggccctgagcgggggtcctcctctgggttctggtcccccaccccccagcatcttctccgctgacttatctgactccagcagcagccggctgtgggacctgctggaggatccatggtgatggattctaggatttacagagacagagaactgatgggggtggagagaagctccttgtgggaggagagggaactaccagcagagcccctcctaccgcagacacaggatcggagacaacctccaaccccacctgcctcctgaagtgctgctgacatgcaactgccttaactttgcctacctggcctccttatgatccccctccggcgtggtatggttggggggcttcttttgctgctggccacggcaaacaagctgcttgctgcttccttca

SEQ ID NO: 152381 - DNA, 4496 bp, Homo sapiens
  Payload ID: 9970
  Gene Symbol: MKL1
  Gene Name: megakaryoblastic leukemia (translocation) 1
  Uniprot ID: Q969V6
  ENST ID: ENST00000355630
  CDS Start-End: 592-3387
ggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacaggcctgtta

SEQ ID NO: 152382 - DNA, 4505 bp, Homo sapiens
  Payload ID: 9970
  Gene Symbol: MKL1
  Gene Name: megakaryoblastic leukemia (translocation) 1
  ENST ID: ENST00000396617
  CDS Start-End: 592-2988
ggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggaggtaaccccagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacaggcctgtt

SEQ ID NO: 152383 - DNA, 747 bp, Homo sapiens
  Payload ID: 9970
  Gene Symbol: MKL1
  Gene Name: megakaryoblastic leukemia (translocation) 1
  ENST ID: ENST00000402630
  CDS Start-End: 192-677
gcacttcaaggggacccttctttcacactacatccttctgtttttagactttttttgcgtttgaaaatgtgttttttgaggtggaatacccaactgacccctcatctctcctctctctctgctgccctgcagtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattggtgaggaggacccagccaccctgtgtgagaggcagctgagatgcaggaggggagggagtgccaggctgaagcagaattgggctgaggctcttgacttcttaatctttgacttcctgcttagccttgggagaaccaaggcacagagtttgagagcctcatgcacaggttgtatgaacttgggatagtgcctgttgctttaagaaacagggacatacaacaataaataataacagaggccttgctctgttcactttc

SEQ ID NO: 152384 - DNA, 4343 bp, Homo sapiens
  Payload ID: 9970
  Gene Symbol: MKL1
  Gene Name: megakaryoblastic leukemia (translocation) 1
  ENST ID: ENST00000402042
  CDS Start-End: 598-3243
gccggcggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacaca

SEQ ID NO: 152385 - DNA, 4091 bp, Homo sapiens
  Payload ID: 9970
  Gene Symbol: MKL1
  Gene Name: megakaryoblastic leukemia (translocation) 1
  Uniprot ID: Q969V6
  ENST ID: ENST00000407029
  CDS Start-End: 208-3003
gcaattacagacagttgcacttcaaggggacccttctttcacactacatccttctgtttttagactttttttgcgtttgaaaatgtgttttttgaggtggaatacccaactgacccctcatctctcctctctctctgctgccctgcagtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaa

SEQ ID NO: 152386 - DNA, 569 bp, Homo sapiens
  Payload ID: 9970
  Gene Symbol: MKL1
  Gene Name: megakaryoblastic leukemia (translocation) 1
  ENST ID: ENST00000422851
  CDS Start-End: 350-569
gactcgcctgaagggtggataaattggtaactgcactgagaaggggatattctcacagtctgatttgagcataaggcatcagattgaatttgtgaaagctttcaagacagcttttctcctgtgactttgactttcttcattatatttgtggatttttgtttctggaagaatccgtcatgactctactggaacctgagatgttaatgatggcagtacagtcagaaaaatgtctcaaattgggtataacaaatcagcgtgattgcctttcacctccactttggagtgctttgagccagtttggacacaaggaggttggagttaaaatgactcctgaaggaagtaagcaagcatgagaagagagggcagcactgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaag

SEQ ID NO: 152387 - DNA, 3757 bp, Homo sapiens
  Payload ID: 9970
  Gene Symbol: MKL1
  Gene Name: megakaryoblastic leukemia (translocation) 1
  ENST ID: ENST00000620651
  CDS Start-End: 1-2649
atgattcctcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacaggcctgtt

SEQ ID NO: 152388 - DNA, 4248 bp, Homo sapiens
  Payload ID: 9970
  Gene Symbol: MKL1
  Gene Name: megakaryoblastic leukemia (translocation) 1
  ENST ID: ENST00000618196
  CDS Start-End: 246-3146
cacttagtatgtcttaactggagagctttttggtttcctgtcggcagtaattcaaatctgtgtcatcttgactcgcctgaagggtggataaattggtaactgcactgagaaggggatattctcacagtctgatttgagcataaggcatcagattgaatttgtgaaagctttcaagacagcttttctcctgtgactttgactttcttcattatatttgtggatttttgtttctggaagaatccgtcatgactctactggaacctgagatgttaatgatggcagtacagtcagtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacagg

SEQ ID NO: 152389 - DNA, 1842 bp, Homo sapiens
  Payload ID: 9970
  Gene Symbol: MKL1
  Gene Name: megakaryoblastic leukemia (translocation) 1
  ENST ID: ENST00000618417
  CDS Start-End: 1339-1596
cgtcattgctgtgaatgggctggacggaggaggggccggcgaaaatgatgatgaaccagtgctcgtgtccttatctgcggcacccagtccccaaagtgctgggattacagacgtgagccactgcacccagcccattgtaactaaccatttttaagtgtatggttcagtggtattaaatacattcataatgtgtacagccatcactgccatccatctccctttcttttgatctcgtaaaactgaaactatccccattaaacagtaacttcccatttggcccttccgccagcctgtagcaactgccattctactttctgtctctatgattttgactaagtgcaatcatgaattgtcttttgtgacaggctgttgcactaagcatagtatcacttccttcatccattgatggacataggttgcttccacattctactgttgtgaatgcacttatcaacacctgtgtacaaatacctgagaccctgcttccaattcttttgggtatatgcccagcagtggaattgctagatcatatggtaattctatttttaagtaagtaagtgttggaggaacctccatactgtttttcatagcagctgcaccattttgcatttctaccacagggcacaagggctccagtttctctgtatcctcaccaatactttcttaaaaatttaattttacagtagccactccagtgggtttgaggtgtatctcactgtggtctccctcatgactagtgatattgagctcttttcatgtgctgttggccatttgtatatcatctttggaaaaatgtctgttcaaatctttcttttacctattcttgagtcaagtttggttttttgttgttgagttttagaagttctctgtgtattccggatatcacttctttatcaaatatgtgatttgcaaatatttttaaagagttttatagtcttagctcttacatttaagtaagtctttgatccgttttatttttgtaaatggtgtgacgttggggggtccaccttcattcttttgcatgtagatatacaggcttggcttctgatatccatttactctcttgattgattggcagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtc

SEQ ID NO: 152390 - DNA, 3917 bp, Homo sapiens
  Payload ID: 9970
  Gene Symbol: MKL1
  Gene Name: megakaryoblastic leukemia (translocation) 1
  ENST ID: ENST00000614754
  CDS Start-End: 1-2400
atgattcctcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggaggtaaccccagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacaggcctgtt

SEQ ID NO: 152391 - DNA, 2133 bp, Homo sapiens
  Payload ID: 9971
  Gene Symbol: MATK
  Gene Name: megakaryocyte-associated tyrosine kinase
  Uniprot ID: P42679
  ENST ID: ENST00000310132
  CDS Start-End: 400-1923
ggccggcggcggcggcggcgcgcggaggagaccgcagtgcggccggcgctaggacccgcgggggcctcccaggccgcggcgcctcccgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgagcagaaaacaggaagaaccaggctcggtccagtggcacccagctccctacctcctgtgccagccgactggcctgtggcaggccattcccagcgtccccgactgtgaccacttgctcagtgtgcctctcacctgcctcagtttccctctgggggcgatggcggggcgaggctctctggtttcctggcgggcatttcacggctgtgattctgctgaggaacttccccgggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaaggac

SEQ ID NO: 152392 - DNA, 1907 bp, Homo sapiens
  Payload ID: 9971
  Gene Symbol: MATK
  Gene Name: megakaryocyte-associated tyrosine kinase
  Uniprot ID: P42679
  ENST ID: ENST00000395040
  CDS Start-End: 297-1697
cggcggcggcggcggcgcgcggaggagaccgcagtgcggccggcgctaggacccgcgggggcctcccaggccgcggcgcctcccgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgagcaggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaaggac

SEQ ID NO: 152393 - DNA, 2073 bp, Homo sapiens
  Payload ID: 9971
  Gene Symbol: MATK
  Gene Name: megakaryocyte-associated tyrosine kinase
  Uniprot ID: P42679
  ENST ID: ENST00000395045
  CDS Start-End: 339-1865
agcaaaatcaagcagttggttagcgaagggattcggtgcagatggatggaccgtctgggctgcggagtccacgggcctgaaacgcggtcgctcctgacccgtcctccgcaaccctcgtcccaccaggccgcggttcccggagcaggccggcgggtggcaggaagacaccaggctgcagggggctggagaagcaacacccctctccctccccgccagagaactggagcgcggggacctcggttgcggatgctagctgcgagccgggttgctaggcgacatcgagagaggaagaggagaaagtcttcatggggtgctagagcatcttaaatgtccctctcatgcagggacatttccctgctgaacgaagagaaggcagacctcggcgagggacccgtggtcagcagcagcttctggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaagg

SEQ ID NO: 152394 - DNA, 594 bp, Homo sapiens
  Payload ID: 9971
  Gene Symbol: MATK
  Gene Name: megakaryocyte-associated tyrosine kinase
  ENST ID: ENST00000591059
  CDS Start-End: 556-594
ctggggcggagggtgctcagaggcgatcggaccccgcgtggtggtggctggggtttcctgggtgcgggtgtgcgcggctacgagccccgggcgtgtgtacccgcgcgtccacgtggagggctgtgcgcgtgtggccgaaaagcgtgtgcgcggccctgcgtagcgccctgcgtgcccgagtggcccggcgctggcgcccaggtgttccagtgtggggcggctgtgtgtgtgccgggggcgggggacaggtgcgcacgttcccaggtgtggagcgcttgtgcgcgcggatgcgcggggacgtgtgcgcacacctgtttccacgtggacgtggtcctttgcttgtctgcgcgcagctgtgtccgagccctgtgtgtttctgtgcgtgtgcatgcatccgtatgcgtaaaacaggaagaaccaggctcggtccagtggcacccagctccctacctcctgtgccagccgactggcctgtggcaggccattcccagcgtccccgactgtgaccacttgctcagtgtgcctctcacctgcctcagtttccctctgggggcgatggcggggcgaggctctctggtttcctggcgggcattt

SEQ ID NO: 152395 - DNA, 711 bp, Homo sapiens
  Payload ID: 9971
  Gene Symbol: MATK
  Gene Name: megakaryocyte-associated tyrosine kinase
  ENST ID: ENST00000588983
  CDS Start-End: 1-711
gtgagctttggccgcgacgtcatccactaccgcgtgctgcaccgcgacggccacctcacaatcgatgaggccgtgttcttctgcaacctcatggacatggtggagaggccacccgggaacggaacaggatgctggggttcccctccctggggctgggctcatggctgtcccaccatcctgcagcattacagcaaggacaagggcgctatctgcaccaagctggtgagaccaaagcggaaacacgggaccaagtcggccgaggaggagctggccaggggtccccagcttcgccactcatctgtcaccatcatccaccatctgagccagaaacctggccccgaacctccacccaccccatcctccagcattccctccttggccaggttcccaagacctgcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctg

SEQ ID NO: 152396 - DNA, 724 bp, Homo sapiens
  Payload ID: 9971
  Gene Symbol: MATK
  Gene Name: megakaryocyte-associated tyrosine kinase
  ENST ID: ENST00000590028
  CDS Start-End: 201-724
aggaagggccggtgtgtgcgcgagtgtgcgcgtcccgggcgcgcagcggaaaacaggaagaaccaggctcggtccagtggcacccagctccctacctcctgtgccagccgactggcctgtggcaggccattcccagcgtccccgactgtgaccacttgctcagtgtgcctctcacctgcctcagtttccctctgggggcgatggcggggcgaggctctctggtttcctggcgggcatttcacggctgtgattctgctgaggaacttccccgggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcga

SEQ ID NO: 152397 - DNA, 562 bp, Homo sapiens
  Payload ID: 9971
  Gene Symbol: MATK
  Gene Name: megakaryocyte-associated tyrosine kinase
  ENST ID: ENST00000590980
  CDS Start-End: 448-562
aaggctgtggggacagagggaagggacaggggaaggggcacaccctggcaggcctggcgatcacagcagcccctggtgggaggcacctcgtcccctgctgtgaaccccaggcggtacctgcagccccgcttccttccttatgccccgggagaggcggctctcggaagcctcccacccacagttcccgttcccatccctggctcccggggaaggcaaacaggattcctgccaccaggccgcggttcccggagcaggccggcgggtggcaggaagacaccaggctgcagggggctggagaagcaacacccctctccctccccgccagagaactggagcgcggggacctcggttgcggatgctagctgcgagccgggttgctaggcgacatcgagagaggaagaggagaaagtcttcatggggtgctagagcatcttaaatgtccctctcatgcagggacatttccctgctgaacgaagagaaggcagacctcggcgagggacccgtggtcagcagcagcttctgaaaacaggaagaaccaggctcggtccagtggcacccagct

SEQ ID NO: 152398 - DNA, 571 bp, Homo sapiens
  Payload ID: 9971
  Gene Symbol: MATK
  Gene Name: megakaryocyte-associated tyrosine kinase
  ENST ID: ENST00000590849
  CDS Start-End: 320-571
agttggttagcgaagggattcggtgcagatggatggaccgtctgggctgcggagtccacgggcctgaaacgcggtcgctcctgacccgtcctccgcaaccctcgtcccaccaggccgcggttcccggagcaggccggcgggtggcaggaagacaccaggctgcagggggctggagaagcaacacccctctccctccccgccagagaactggagcgcggggacctcggttgcggatgctagctgcgagccgggttgctaggcgacatcggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacggg

SEQ ID NO: 152399 - DNA, 1994 bp, Homo sapiens
  Payload ID: 9971
  Gene Symbol: MATK
  Gene Name: megakaryocyte-associated tyrosine kinase
  ENST ID: ENST00000585778
  CDS Start-End: 266-1786
ggagcaactcgctccaagttgtgcagccgggaccgcctcggggtgtgcagccggctcgcggaggccctcctgggggcgggcgcggggcgcggctcgggggcgccccctgagcagaaaacaggaagaaccaggctcggtccagtggcacccagctccctacctcctgtgccagccgactggcctgtggcaggccattcccagcgtccccgactgtgaccacttgctcagtgtgcctctcacctgcctcagtttccctctgggggcgatggcggggcgaggctctctggtttcctggcgggcatttcacggctgtgattctgctgaggaacttccccgggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaagg

SEQ ID NO: 152400 - DNA, 741 bp, Homo sapiens
  Payload ID: 9971
  Gene Symbol: MATK
  Gene Name: megakaryocyte-associated tyrosine kinase
  ENST ID: ENST00000587180
  CDS Start-End: 348-741
cctctccgctcttttccaatctctatacctttctccctcctgtcctctttcccctcccgtgcctctgctccccacatctccgtgatgtcctccctttgcccctctcccggccccctctgcagaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgc

SEQ ID NO: 152401 - DNA, 801 bp, Homo sapiens
  Payload ID: 9971
  Gene Symbol: MATK
  Gene Name: megakaryocyte-associated tyrosine kinase
  ENST ID: ENST00000590493
  CDS Start-End: 1-801
tccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagaggccacccgggaacggaacaggatgctggggttcccctccctggggctgggctcatggctgtcccaccatcctgcagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgac

SEQ ID NO: 152402 - DNA, 1990 bp, Homo sapiens
  Payload ID: 9971
  Gene Symbol: MATK
  Gene Name: megakaryocyte-associated tyrosine kinase
  ENST ID: ENST00000612526
  CDS Start-End: 266-1849
ggagcaactcgctccaagttgtgcagccgggaccgcctcggggtgtgcagccggctcgcggaggccctcctgggggcgggcgcggggcgcggctcgggggcgccccctgagcagaaaacaggaagaaccaggctcggtccagtggcacccagctccctacctcctgtgccagccgactggcctgtggcaggccattcccagcgtccccgactgtgaccacttgctcagtgtgcctctcacctgcctcagtttccctctgggggcgatggcggggcgaggctctctggtttcctggcgggcatttcacggctgtgattctgctgaggaacttccccgggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagccgcccgccggccacccttccgcaaactggccgagaagctggcccgggagctacgcagtgcaggtgccccagcctccgtctcagggcaggacgccgacgctccacctcgccccgaagccaggagccctgaccccacccggtggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaagg

SEQ ID NO: 152403 - DNA, 1740 bp, Homo sapiens
  Payload ID: 9971
  Gene Symbol: MATK
  Gene Name: megakaryocyte-associated tyrosine kinase
  Uniprot ID: P42679
  ENST ID: ENST00000619596
  CDS Start-End: 1-1527
atgcagggacatttccctgctgaacgaagagaaggcagacctcggcgagggacccgtggtcagcagcagcttctggtgagcccccgcttcctccgagcctggcacccccctcccgtctcagccaggatgccaacgaggcgctgggccccgggcacccagtgtatcaccaaatgcgagcacacccgccccaagccaggggagctggccttccgcaagggcgacgtggtcaccatcctggaggcctgcgagaacaagagctggtaccgcgtcaagcaccacaccagtggacaggaggggctgctggcagctggggcgctgcgggagcgggaggccctctccgcagaccccaagctcagcctcatgccgtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggagcattacagcaaggacaagggcgctatctgcaccaagctggtgagaccaaagcggaaacacgggaccaagtcggccgaggaggagctggccagggcgggctggttactgaacctgcagcatttgacattgggagcacagatcggagagggagagtttggagctgtcctgcagggtgagtacctggggcaaaaggtggccgtgaagaatatcaagtgtgatgtgacagcccaggccttcctggacgagacggccgtcatgacgaagatgcaacacgagaacctggtgcgtctcctgggcgtgatcctgcaccaggggctgtacattgtcatggagcacgtgagcaagggcaacctggtgaactttctgcggacccggggtcgagccctcgtgaacaccgctcagctcctgcagttttctctgcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacgggaagttcaccagcaagtcggatgtctggagttttggggtgctgctctgggaggtcttctcatatggacgggctccgtaccctaaaatgtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaaggactct

SEQ ID NO: 152404 - DNA, 3933 bp, Homo sapiens
  Payload ID: 9972
  Gene Symbol: MLC1
  Gene Name: megalencephalic leukoencephalopathy with subcortical cysts 1
  Uniprot ID: Q15049
  ENST ID: ENST00000311597
  CDS Start-End: 608-1741
aaagggggcagcaggaccgggcccaccagccatccgggctgcccacgcaaaccacagggccgaatccggagccgcccaaggccacacagctaagccgagtgcgtgaatgcttatgtgaccgtgtgaaggaggttcccaccgtgtggctgtgggggatggaaaaaggctacttggaaagatgtagaagaccttcgagtaaacagttacgtttcagaaacagagcctgctcagaatgtgtacttggtgggattctattcttagggacgcttctttcttctgagagacccgagctctgtggcgagtggcacaggcagggccccttcctttcctagttgggttctgacagctccgaggcagtggtttacacaaccaacacgaaacatttctacgatccacccgattcctcccctcattgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagacgtg

SEQ ID NO: 152405 - DNA, 3601 bp, Homo sapiens
  Payload ID: 9972
  Gene Symbol: MLC1
  Gene Name: megalencephalic leukoencephalopathy with subcortical cysts 1
  Uniprot ID: Q15049
  ENST ID: ENST00000395876
  CDS Start-End: 276-1409
gtaagtgctcagacattaagccgttgagtagaggcatgttttgcaatctctcgtttagctaccaattggagcagtttaacgtgcttgagtccccggcgtgatgtgttcatggacgaagttgccgatggatgttgtcaggtgttgcacctggagggcccagatggatcaatgaggcatttaaagtgtagaatctcaccctgaacccagactattcagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagacgtg

SEQ ID NO: 152406 - DNA, 758 bp, Homo sapiens
  Payload ID: 9972
  Gene Symbol: MLC1
  Gene Name: megalencephalic leukoencephalopathy with subcortical cysts 1
  ENST ID: ENST00000442311
  CDS Start-End: 90-758
agtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggtgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtccc

SEQ ID NO: 152407 - DNA, 2543 bp, Homo sapiens
  Payload ID: 9973
  Gene Symbol: M1AP
  Gene Name: meiosis 1 associated protein
  Uniprot ID: Q8TC57
  ENST ID: ENST00000290536
  CDS Start-End: 118-1710
gggcccggagcttcctccgcggggcccccaggcccgagggccgggctgctgatccgccaggcacggtgtaaagaatatccagctggtggctacagttccccctctggttttgctgccatgcatcctgggcgaactactggtaaagggccctctactcacactcagattgaccagcaacctccacggcttctcattgtgcacattgctctaccgtcctgggctgacatctgcaccaacctctgtgaggctctgcagaacttcttctctctagcctgcagcttgatgggccccagccgcatgtccctgttcagtttatacatggtacaagatcagcatgagtgcatcctcccttttgtgcaagtgaaagggaactttgctaggttgcagacctgcatctcagaactccgcatgttacagagagaagggtgtttcagatcacaaggtgcttctctgcggctggcagtagaggatgggctccagcaattcaaacaatacagcagacatgtgaccacaagggcagctctgacctatacctccctggagattactattctgacttctcagcctggaaaagaggtggtcaaacagttggaggaagggttgaaagatacagacctagccagagtcaggaggtttcaggtcgttgaggtcacaaagggaatcctagagcacgtggactcagcgtctcctgttgaggataccagcaatgatgagagttctattctgggaactgacattgaccttcagactatagacaatgatatcgtcagcatggagattttcttcaaagcctggctacataacagtggaacagaccaagaacaaatccatcttcttctttcttcacagtgtttcagcaacatttccagacccagagataatccaatgtgtctgaaatgtgatctccaagagcgactgctctgcccatccctactcgctggcacagctgacggctccttgagaatggatgaccctaaaggagacttcatcacactctaccagatggcttcccagtcatcggcctctcattacaagctccaagtgatcaaggctttaaaatctagcgggctctgcgagtcattgacatatggactcccgttcatcctcagacctacaagctgttggcagctggactgggatgagctggagacaaatcagcaacatttccatgctttgtgtcacagcctgctgaaaagggaatggctgctgttagccaagggggaaccaccgggcccaggacacagccagagaattcctgccagcaccttctatgtgatcatgccgtcacactccctcacactgctggtaaaggcggtggccacgcgggaactgatgctgcccagcaccttccccctgctacctgaggacccacatgatgatagccttaagaatgtggagagcatgctggacagcctggagctggagcccacctacaaccccttgcatgttcaaagccacctgtactcacacctgagcagcatctatgccaagcctcaggggcggctccacccacactgggagagccgagctccgagaaagcatccctgcaagactgggcagttgcagaccaaccgagctcgagctactgtggcccccctgcctatgactcctgtcccaggcagagcctccaagatgccagcagccagcaaatcttcctcagatgccttcttcctgccttcagagtgggagaaggatccctcaaggccctaagtcaccagcaccagagcccagctgcccagcttaaccatatccatgctcaggttcacataatggctatctgtggtcagacttgctctctatccgcctgagcctctgtgagtgagggctgactgggaaacaacagccttcctgtcctgtttcagtgctgtcccactcctcaagtctggaagcgacacacccgagcctgtcctttctccagcaaggactttcattttctttagaatcatttgctactgtttacacaggtgaagattaaacacccagtaagcttctaccattgttaggagcattcataactcagaatttcttcttgtagctctgtgtaagcaggtggatgaggtcagatcacctttggtaaactggacctcaggaacaaggatgaggttttgaaagctcataaaagacaagtaagattgaaatccaagcctcatttcagagcctgtgcccttcccactacaccaccaggcttcagcctccaaagagacaagtgcttggtacctacatgcaaagtgtgtgtgctggggggtgggagggctgcccagaacaggggagaggatggtgtaaaaaaagacctactcctttcctgttaccctctccccacatgtaccaaccttcctgttgctccctccatccacagaataatagctaccatttataaaatgtttactctgggctgggagcagtggctcacacctgtaatcccaacactttgagaggctgaggtgggatgatcacttgaggccaggagttcgagaccagcctgagcaacactgtgagacccccccgccatctctacataaataataaaaacttttaaaaaaaca

SEQ ID NO: 152408 - DNA, 2457 bp, Homo sapiens
  Payload ID: 9973
  Gene Symbol: M1AP
  Gene Name: meiosis 1 associated protein
  Uniprot ID: Q8TC57
  ENST ID: ENST00000409585
  CDS Start-End: 53-1633
gtgtaaagaatatccagctggtggctacagttccccctctggttttgctgccatgcatcctgggcgaactactggtaaagggccctctactcacactcagattgaccagcaacctccacggcttctcattgtgcacattgctctaccgtcctgggctgacatctgcaccaacctctgtgaggctctgcagaacttcttctctctagcctgcagcttgatgggccccagccgcatgtccctgttcagtttatacatggtacaagatcagcatgagtgcatcctcccttttgtgcaagtgaaagggaactttgctaggttgcagacctgcatctcagaactccgcatgttacagagagaagggtgtttcagatcacaaggtgcttctctgcggctggcagtagaggatgggctccagcaattcaaacaatacagcagacatgtgaccacaagggcagctctgacctatacctccctggagattactattctgacttctcagcctggaaaagaggtggtcaaacagttggaggaagggttgaaagatacagacctagccagagtcaggaggtttcaggtcgttgaggtcacaaagggaatcctagagcacgtggactcagcgtctcctgttgaggataccagcaatgatgagagttctattctgggaactgacattgaccttcagactatagacaatgatatcgtcagcatggagattttcttcaaagcctggctacataacagtggaacagaccaagaacaaatccatcttcttctttcttcacagtgtttcagcaacatttccagacccagagataatccaatgtgtctgaaatgtgatctccaagagcgactgctctgcccatccctactcgctggcacagctgacggctccttgagaatggatgaccctaaaggagacttcatcacactctaccagatggcttcccagtcatcggcctctcattacaagctccaagtgatcaaggctttaaaatctagcgggctctgcgagtcattgacatatggactcccgttcatcctcagacctacaagctgttggcagctggactgggatgagctggagacaaatcagcaacatttccatgctttgtgtcacagcctgctgaaaagggaatggctgctgttagccaagggggaaccaccgggcccaggacacagccagagaattcctgccagcaccttctatgtgatcatgccgtcacactccctcacactgctggtaaaggcggtggccacgcgggaactgatgctgcccagcaccttccccctgctacctgaggacccacatgatgatagccttaagaatgtggagagcatgctggacagcctggagctggagcccacctacaaccccttgcatgttcaaagccacctgtactcacacctgagcagcatctatgccaagcctcaggggcggctccacccacactgggagagccgagctccgagaaagactgggcagttgcagaccaaccgagctcgagctactgtggcccccctgcctatgactcctgtcccaggcagagcctccaagatgccagcagccagcaaatcttcctcagatgccttcttcctgccttcagagtgggagaaggatccctcaaggccctaagtcaccagcaccagagcccagctgcccagcttaaccatatccatgctcaggttcacataatggctatctgtggtcagacttgctctctatccgcctgagcctctgtgagtgagggctgactgggaaacaacagccttcctgtcctgtttcagtgctgtcccactcctcaagtctggaagcgacacacccgagcctgtcctttctccagcaaggactttcattttctttagaatcatttgctactgtttacacaggtgaagattaaacacccagtaagcttctaccattgttaggagcattcataactcagaatttcttcttgtagctctgtgtaagcaggtggatgaggtcagatcacctttggtaaactggacctcaggaacaaggatgaggttttgaaagctcataaaagacaagtaagattgaaatccaagcctcatttcagagcctgtgcccttcccactacaccaccaggcttcagcctccaaagagacaagtgcttggtacctacatgcaaagtgtgtgtgctggggggtgggagggctgcccagaacaggggagaggatggtgtaaaaaaagacctactcctttcctgttaccctctccccacatgtaccaaccttcctgttgctccctccatccacagaataatagctaccatttataaaatgtttactctgggctgggagcagtggctcacacctgtaatcccaacactttgagaggctgaggtgggatgatcacttgaggccaggagttcgagaccagcctgagcaacactgtgagacccccccgccatctctacataaataataaaaactttt

SEQ ID NO: 152409 - DNA, 576 bp, Homo sapiens
  Payload ID: 9973
  Gene Symbol: M1AP
  Gene Name: meiosis 1 associated protein
  ENST ID: ENST00000422394
  CDS Start-End: 98-565
gagccgggaggaccaggtgagggggcctccgtcttccgaagacaggtgtaaagaatatccagctggtggctacagttccccctctggttttgctgccatgcatcctgggcgaactactggtaaagggccctctactcacactcagattgaccagcaacctccacggcttctcattgtgcacattgctctaccgtcctgggctgacatctgcaccaacctctgtgaggctctgcagaacttcttctctctagcctgcagcttgatgggccccagccgcatgtccctgttcagtttatacatggtacaagatcagcatgagtgcatcctcccttttgtgcaagtgaaagggaactttgctaggttgcagacctgcatctcagaactccgcatgttacagagagaagggtgtttcagatcacaaggtgcttctctgcggctggcagtagaggatgggctccagcaattcaaacaatacagcagacatgtgaccacaagggcagctctgacctatacctccctggagagagttctattctgggaactgacattgaccttcagactatagacaatgatatc

SEQ ID NO: 152410 - DNA, 789 bp, Homo sapiens
  Payload ID: 9973
  Gene Symbol: M1AP
  Gene Name: meiosis 1 associated protein
  ENST ID: ENST00000438226
  CDS Start-End: 127-408
gcgcctccgaacgcgcgggcgcacgctgagagccgggaggaccaggtgagggggcctccgtcttccgaagacaggtgtaaagaatatccagctggtggctacagttccccctctggttttgctgccatgcatcctgggcgaactactggtaaagggccctctactcacactcagattgaccagcaacctccacggcttctcattgtgcacattgctctaccgtcctgggctgacatctgcaccaacctctgtgaggctctgcagaacttcttctctctagcctgcagcttgatgggccccagccgcatgtccctgttcagtttatacatggtacaagatcagcatgagtgcatcctcccttttgtgagagttctattctgggaactgacattgaccttcagactatagacaatgatatcgtcagcatggagattttcttcaaagcctggctacataacagtggaacagaccaagaacaaatccatcttcttctttcttcacagtgtttcagcaacatttccagacccagagataatccaatgtgtctgaaatgtgatctccaagagcgactgctctgcccatccctactcgctggcacagctgacggctccttgagaatggatgaccctaaaggagacttcatcacactctaccagatggcttcccagtcatcggcctctcattacaagctccaagtgatcaaggctttaaaatctagcgggctctgcgagtcattgacatatggactcccgttcatcctcagacctacaagctgttggcagctggact

SEQ ID NO: 152411 - DNA, 544 bp, Homo sapiens
  Payload ID: 9973
  Gene Symbol: M1AP
  Gene Name: meiosis 1 associated protein
  ENST ID: ENST00000421985
  CDS Start-End: 119-544
gaacgcgcgggcgcacgctgagagccgggaggaccaggtgagggggcctccgtcttccgaagacaggtgtaaagaatatccagctggtggctacagttccccctctggttttgctgccatgcatcctgggcgaactactggtaaagggccctctactcacactcagattgaccagcaacctccacggcttctcattgtgcacattgctctaccgtcctgggctgacatctgcaccaacctctgtgaggctctgcagaacttcttctctctagcctgcagcttgatgggccccagccgcatgtccctgttcagtttatacatggtacaagatcagcatgagtgcatcctcccttttgtgcaagtgaaagggaactttgctaggttgcagacctgcatctcagaactccgcatgttacagagagaagggtgtttcagatcacaaggtgcttctctgcggctggcagtagaggatgggctccagcaattcaaacaatacagcagacatgtgaccacaagggcagctctgacctatacctccctggag

SEQ ID NO: 152412 - DNA, 2531 bp, Homo sapiens
  Payload ID: 9973
  Gene Symbol: M1AP
  Gene Name: meiosis 1 associated protein
  Uniprot ID: Q8TC57
  ENST ID: ENST00000536235
  CDS Start-End: 127-1707
gcgcctccgaacgcgcgggcgcacgctgagagccgggaggaccaggtgagggggcctccgtcttccgaagacaggtgtaaagaatatccagctggtggctacagttccccctctggttttgctgccatgcatcctgggcgaactactggtaaagggccctctactcacactcagattgaccagcaacctccacggcttctcattgtgcacattgctctaccgtcctgggctgacatctgcaccaacctctgtgaggctctgcagaacttcttctctctagcctgcagcttgatgggccccagccgcatgtccctgttcagtttatacatggtacaagatcagcatgagtgcatcctcccttttgtgcaagtgaaagggaactttgctaggttgcagacctgcatctcagaactccgcatgttacagagagaagggtgtttcagatcacaaggtgcttctctgcggctggcagtagaggatgggctccagcaattcaaacaatacagcagacatgtgaccacaagggcagctctgacctatacctccctggagattactattctgacttctcagcctggaaaagaggtggtcaaacagttggaggaagggttgaaagatacagacctagccagagtcaggaggtttcaggtcgttgaggtcacaaagggaatcctagagcacgtggactcagcgtctcctgttgaggataccagcaatgatgagagttctattctgggaactgacattgaccttcagactatagacaatgatatcgtcagcatggagattttcttcaaagcctggctacataacagtggaacagaccaagaacaaatccatcttcttctttcttcacagtgtttcagcaacatttccagacccagagataatccaatgtgtctgaaatgtgatctccaagagcgactgctctgcccatccctactcgctggcacagctgacggctccttgagaatggatgaccctaaaggagacttcatcacactctaccagatggcttcccagtcatcggcctctcattacaagctccaagtgatcaaggctttaaaatctagcgggctctgcgagtcattgacatatggactcccgttcatcctcagacctacaagctgttggcagctggactgggatgagctggagacaaatcagcaacatttccatgctttgtgtcacagcctgctgaaaagggaatggctgctgttagccaagggggaaccaccgggcccaggacacagccagagaattcctgccagcaccttctatgtgatcatgccgtcacactccctcacactgctggtaaaggcggtggccacgcgggaactgatgctgcccagcaccttccccctgctacctgaggacccacatgatgatagccttaagaatgtggagagcatgctggacagcctggagctggagcccacctacaaccccttgcatgttcaaagccacctgtactcacacctgagcagcatctatgccaagcctcaggggcggctccacccacactgggagagccgagctccgagaaagactgggcagttgcagaccaaccgagctcgagctactgtggcccccctgcctatgactcctgtcccaggcagagcctccaagatgccagcagccagcaaatcttcctcagatgccttcttcctgccttcagagtgggagaaggatccctcaaggccctaagtcaccagcaccagagcccagctgcccagcttaaccatatccatgctcaggttcacataatggctatctgtggtcagacttgctctctatccgcctgagcctctgtgagtgagggctgactgggaaacaacagccttcctgtcctgtttcagtgctgtcccactcctcaagtctggaagcgacacacccgagcctgtcctttctccagcaaggactttcattttctttagaatcatttgctactgtttacacaggtgaagattaaacacccagtaagcttctaccattgttaggagcattcataactcagaatttcttcttgtagctctgtgtaagcaggtggatgaggtcagatcacctttggtaaactggacctcaggaacaaggatgaggttttgaaagctcataaaagacaagtaagattgaaatccaagcctcatttcagagcctgtgcccttcccactacaccaccaggcttcagcctccaaagagacaagtgcttggtacctacatgcaaagtgtgtgtgctggggggtgggagggctgcccagaacaggggagaggatggtgtaaaaaaagacctactcctttcctgttaccctctccccacatgtaccaaccttcctgttgctccctccatccacagaataatagctaccatttataaaatgtttactctgggctgggagcagtggctcacacctgtaatcccaacactttgagaggctgaggtgggatgatcacttgaggccaggagttcgagaccagcctgagcaacactgtgagacccccccgccatctctacataaataataaaaactttt

SEQ ID NO: 152413 - DNA, 1694 bp, Homo sapiens
  Payload ID: 9974
  Gene Symbol: MEIOB
  Gene Name: meiosis specific with OB domains
  Uniprot ID: Q8N635
  ENST ID: ENST00000325962
  CDS Start-End: 11-1426
gattaaaaaaatggcaaactcctttgcagcgaggattttcactaccctttcagatctgcagacaaatatggctaatctgaaagttatcggtatagttattgggaaaacagatgtcaaaggctttccagacagaaaaaatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagatataccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgcacggtacatgagtttcttgcaatgacagatgaacagaaaacagcattaaagtggcaatttctcttggaaagaagcaaaatttatttaaaattcgttctatcacacagagcaaggagtggattgaaaattagtgtactctcgtgcaagcttgcagatcctactgaggcaagcagaaacttgtctggacaaaaacatgtttaaaacggtctatcattttgaactctggaaaagtataagagttttaactccctttaaaatggaatattaatttgaaaattatggggaaaattgcattttgtttacatgtggtgaacatgtttctagaaattgttatggtggaggtggtctgggtgagtctgaaggcctctctcatctgacctcccttcttagaaggcctcctactgtctttgccttgtctcctcccaagttggaaaatgtttacatgaattaataaacagatttaatcttc

SEQ ID NO: 152414 - DNA, 1792 bp, Homo sapiens
  Payload ID: 9974
  Gene Symbol: MEIOB
  Gene Name: meiosis specific with OB domains
  Uniprot ID: Q8N635
  ENST ID: ENST00000397344
  CDS Start-End: 196-1524
gctgaggacggggcggggcctcgcgctaacggtcgcgcggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggattaaaaaaatggcaaactcctttgcagcgaggattttcactaccctttcagatctgcagacaaatatggctaatctgaaagttatcggtatagttattgggaaaacagatgtcaaaggctttccagacagaaaaaatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagatataccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgcacgttcgttctatcacacagagcaaggagtggattgaaaattagtgtactctcgtgcaagcttgcagatcctactgaggcaagcagaaacttgtctggacaaaaacatgtttaaaacggtctatcattttgaactctggaaaagtataagagttttaactccctttaaaatggaatattaatttgaaaattatggggaaaattgcattttgtttacatgtggtgaacatgtttctagaaattgttatggtggaggtggtctgggtgagtctgaaggcctctctcatctgacctcccttcttagaaggcctcctactgtctttgccttgtctcctcccaagttggaaaatgtttacatgaattaataaacagatttaatcttc

SEQ ID NO: 152415 - DNA, 1884 bp, Homo sapiens
  Payload ID: 9974
  Gene Symbol: MEIOB
  Gene Name: meiosis specific with OB domains
  Uniprot ID: Q8N635
  ENST ID: ENST00000412554
  CDS Start-End: 196-1611
gctgaggacggggcggggcctcgcgctaacggtcgcgcggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggattaaaaaaatggcaaactcctttgcagcgaggattttcactaccctttcagatctgcagacaaatatggctaatctgaaagttatcggtatagttattgggaaaacagatgtcaaaggctttccagacagaaaaaatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagatataccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgcacggtacatgagtttcttgcaatgacagatgaacagaaaacagcattaaagtggcaatttctcttggaaagaagcaaaatttatttaaaattcgttctatcacacagagcaaggagtggattgaaaattagtgtactctcgtgcaagcttgcagatcctactgaggcaagcagaaacttgtctggacaaaaacatgtttaaaacggtctatcattttgaactctggaaaagtataagagttttaactccctttaaaatggaatattaatttgaaaattatggggaaaattgcattttgtttacatgtggtgaacatgtttctagaaattgttatggtggaggtggtctgggtgagtctgaaggcctctctcatctgacctcccttcttagaaggcctcctactgtctttgccttgtctcctcccaagttggaaaatgtttacatgaattaataaacagatttaatcttctacag

SEQ ID NO: 152416 - DNA, 807 bp, Homo sapiens
  Payload ID: 9974
  Gene Symbol: MEIOB
  Gene Name: meiosis specific with OB domains
  ENST ID: ENST00000496541
  CDS Start-End: 647-807
gcgcggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagatat

SEQ ID NO: 152417 - DNA, 1857 bp, Homo sapiens
  Payload ID: 9974
  Gene Symbol: MEIOB
  Gene Name: meiosis specific with OB domains
  ENST ID: ENST00000470044
  CDS Start-End: 794-1588
accgtcttacacaataccaaccgcccatcaggttgtttcaaaggctttcagccactgactaatagaaaaagagactgcatacaacgtttcattcatgttttgctaggctagatacatttgttgtagcggtctcatatttgtaagtccgtggaaaaacctgaaagtatttttttcttgaaaatttttttgaaaaaaaagtaaaatgtcattaggagtgagaatcaggaatgatggattcacggtctagttgcaagactcatcacaggccattaacctctgaaaagcctttatctgcttcgatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagatataccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgcacggtacatgagtttcttgcaatgacagatgaacagaaaacagcattaaagtggcaatttctcttggaaagaagcaaaatttatttaaaattcgttctatcacacagagcaaggagtggattgaaaattagtgtactctcgtgcaagcttgcagatcctactgaggcaagcagaaacttgtctggacaaaaacatgtttaaaacggtctatcattttgaactctggaaaagtataagagttttaactccctttaaaatggaatattaatttgaaaattatggggaaaattgcattttgtttacatgtggtgaacatgtttctagaaattgttatggtggaggtggtctgggtgagtctgaaggcctctctcatctgacctcccttcttagaaggcctcctactgtctttgccttgtctcctcccaagttggaaaatgtttacatgaattaataaacagatttaatcttct

SEQ ID NO: 152418 - DNA, 605 bp, Homo sapiens
  Payload ID: 9974
  Gene Symbol: MEIOB
  Gene Name: meiosis specific with OB domains
  ENST ID: ENST00000460494
  CDS Start-End: 113-244
aagccgcgaagcgcgggcgacccgggggtcgggcgggccaggtccgcgaggccgcggcggcagctgtgcaggcccggggagcagccggccgggcgagcctcggattaaaaaaatggcaaactcctttgcagcgaggattttcactaccctttcagatctgcagacaaatatggctaatctgatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggtaagttaaaaccccgacaaagc

SEQ ID NO: 152419 - DNA, 507 bp, Homo sapiens
  Payload ID: 9975
  Gene Symbol: MEIG1
  Gene Name: meiosis/spermiogenesis associated 1
  Uniprot ID: Q5JSS6
  ENST ID: ENST00000378240
  CDS Start-End: 31-297
gatattattgataataaggcctctgtaaccatggctagttctgacgtaaaaccaaaatcagtaagtcatgccaaaaaatggtcagaagagatagaaaatctgtacagatttcaacaagcaggatatcgggatgaaaccgaatatagacaagtgaaacaagtttctatggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttgg

SEQ ID NO: 152420 - DNA, 625 bp, Homo sapiens
  Payload ID: 9975
  Gene Symbol: MEIG1
  Gene Name: meiosis/spermiogenesis associated 1
  Uniprot ID: Q5JSS6
  ENST ID: ENST00000407572
  CDS Start-End: 149-415
cctgctcgcggatcccgagtagagaacgcaagcacccacgcccgcctgcaagctcccgggcgcccccggcctctcctgctcggcggaacgaggataacccagtagagccggacccagggatattattgataataaggcctctgtaaccatggctagttctgacgtaaaaccaaaatcagtaagtcatgccaaaaaatggtcagaagagatagaaaatctgtacagatttcaacaagcaggatatcgggatgaaaccgaatatagacaagtgaaacaagtttctatggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttgg

SEQ ID NO: 152421 - DNA, 2023 bp, Homo sapiens
  Payload ID: 9976
  Gene Symbol: MNS1
  Gene Name: meiosis-specific nuclear structural 1
  Uniprot ID: Q8NEH6
  ENST ID: ENST00000260453
  CDS Start-End: 166-1653
acttttggtcgagcggagggcgcgcagctccaccgttgccaagacgccgcgtaaacacccgagcgcgcgcagccaggtgcgctccttggggctgctggctgctgcgtttgcggcgggaggtggtggccgcggtcccacgagagggggtatttttcgtcagccaagatgggttccaaaaggagaaatttgagctgtagtgaaaggcatcagaaattagtagatgaaaactactgcaaaaaattacatgtccaagctctaaaaaacgtcaacagtcaaatcaggaatcaaatggtgcagaatgaaaatgataaccgtgttcagcgcaagcaatttctcagattattacaaaatgaacaatttgagttggatatggaagaggccattcaaaaggcagaagaaaacaagagattgaaagaactccagctcaaacaagaagaaaaactggctatggaattggcaaaactgaaacatgaaagtctaaaggacgaaaagatgaggcaacaagtaagagaaaacagcattgagcttagagaattggagaagaaattaaaagcagcttacatgaataaagaaagggcagctcagattgctgaaaaggatgccattaaatatgaacaaatgaaacgtgatgctgaaatagccaaaaccatgatggaagaacacaagagaataataaaggaagagaatgctgcagaagacaaacgaaacaaagcgaaagcacagtactatcttgacttagagaaacaacttgaagaacaagaaaaaaaaaagcaggaagcttatgagcagctgctaaaagagaaactcatgattgatgaaattgttaggaagatctatgaagaagatcagttggaaaaacaacaaaagttagaaaaaatgaatgcaatgcgaaggtatatagaagagtttcagaaagagcaggctctctggagaaaaaagaaacgtgaggagatggaagaagaaaacagaaaaatcatagagtttgctaacatgcagcagcaaagagaagaagatcggatggcaaaagttcaagaaaatgaggagaaaaggctacagcttcagaatgcgttgacacagaaattagaagaaatgctgcggcaacgtgaagatttggaacaagtgcgacaagaattataccaggaagaacaagctgaaatatataagagcaagctaaaagaagaagcagaaaagaaattgagaaagcaaaaagagatgaagcaagattttgaagaacaaatggccttgaaggaattagtgctacaggctgcaaaagaggaagaggagaactttagaaaaactatgctagctaaatttgctgaggatgatcgaatagaattaatgaatgctcagaaacaaagaatgaagcagctggaacacaggagggctgtggaaaaacttattgaagagcgtcgccaacaattccttgcagacaaacaacgtgaactagaagagtggcagttgcagcaaaggcggcaaggatttattaatgcaattattgaagaagaaaggctaaaacttcttaaagagcatgctacaaacttactaggctatctccctaaaggagtatttaaaaaagaggatgatattgatctgcttggtgaagagttcaggaaagtatatcaacaaaggagtgaaatttgtgaagagaaatgatatcatcaaaattgggtaaagcatagattttttgcatgttaccactagatgtcagcataacttttgttttacagttcagtggcattaggtatccattgtctgtttggattttgtaaatcatcactgaatttcataacttgtaaacaattatcagatacaaattaattttaatcaagctgttatttttgtactgataatttcaaaatccgatttctacaacactacagagcactgtttgcatccccatcctcaagacagtatatttaccttgactaatacagaactctaccccaaagtgaactgccttctgtctgtgtttacgaactttacttacttgatttagccagggaaataaatatttggaattttc

SEQ ID NO: 152422 - DNA, 4020 bp, Homo sapiens
  Payload ID: 9977
  Gene Symbol: MEI1
  Gene Name: meiotic double-stranded break formation protein 1
  Uniprot ID: Q5TIA1
  ENST ID: ENST00000401548
  CDS Start-End: 41-3865
gcgggaaagagtgccgcctcagctgagggcaagcgaggagatggctgtgaggcaggcggcgacggcgggcactcccgggcccaggagagaggaagaggcggcgcttctattcgagagggcccattaccggcacgacccgcgctggctgctgcccgtgaccccccgcctgtgcctggcctgcgcgctggagctgctgccggaccccggcgtgtcgttagtgcgcaagaagcacatgttgtcctgcttccaagatgcccttgtgaggcatacctccctggtcacgcaactggtgtctcaggatcagagagtctgcatccacttcataagtgtgctttttggactattatgcagcatggaagatgggagtgtgacagacctctgtattgaagtccttattcagatcacaacgcagctgaagctggagcagactatccgttgcctgctggatgagtgccacaaagagctgtgtaacatgccctccatgcgaggcagcctggccaccctgacccttcttggcaagttggtggatgccatccctgctctggcagacgagcttgtaatggagcatggcaacctgatggagcatctgttgagaggcttagtataccccagtgagggcatacaagcttctgtctgttacctttatgggaagctatactcctcaccagtggcagctgagatgctttcaggacacttccgtgagaagctttttcccctcttcctttccatcctggatggtgcccagacaaaggagctgcagattaactgcttgggtttgctgaggcagctgttgaagtatgatctctttgtgtccatgatcatgaaccaggatggactgggagaaagtgctaagaatatcgaagggtcatcaggaaatacctcactgcctttggtgctcaaaaagcttctcctctctagagatgaaaccctgcaggtggccagtgctcactgtataactgcggtgcttgtccactccccagcaaagcatgcgtcagccttcatccacgctgacatcccagagttcctctttgagcatctttcttcttccagtgaagtgctcgtctggtccagctgtaactgcttgacactcctggtagaagagccactctttttttccaagtgccacacggtgtatgggatcgaggcagtggtgaggagcctgcagggaagcctgaagatgaacaacatagagctgcacaagcagggcctgctgcttttcgctgaaatcctgacccggcagccagaggagatcaagctgttcacaagctcagccatgtgcagagatgctggccgtgccctccaagaagcagttagcagccctgtgctggaggtggctgctgaggccttgaaggccacttctgcttttctgaggaaggaccatcagagcactccacctgtgcagtatggggaactgcaggctttgctagaagccatgctaaaccgatgtgcggagttttcccagaccttgctgagcaggaggcccctgggccatgcctccagtagagattcagagaaggccattcttcaaaggggaaagttcctcctcagcactctggagggatttagaagtgcctgcaggttggctatagaattccagagtgagccttcagcccaggagaatccattcacagctcccagcgccaagaaggaagacaccttggaggccttctcagaatttcttctcagtgcctgtgactcgctgtgtatccccatggtgatgagacacttggagcagaccacccacccagctttgatggaagttttcctctcaattctacataacctctttgtcatcgttccccacatgaaggagaagttttccaagaagcttgcttcctcatccttcatacgactgaccctggagctgaaggccaggttttgcagtggtctgagtcactcagccctaaaccaggtgtgttccaatttcctctactatatgtgcctcaaccttctctcagctccagagaagacaggaccaccttccaaagaagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggtttgtctcagaggcagagttatttgaggctgtgcaaagcttcctcctgtcgctgcaggaccagggcgagcgccccccactggtggtcttcaaagcctccatctatctgcttgcaatctgccaggacaaagacaatacactacgtgagactatggtcagtgcaatcagaaaattcctagaaggcatcccagacctgcagctagtctatactcaccatccgctcctgctcaggttctttctgttgtatccagagctcatgagtaggtatgggcaccgtgtcctggaactttggttcttctgggaagagagcagctatgaggaactggatgatgtcacctctgctgggcagcccgcccttcctgccagcttagtagtcctgttccagttgctcagaagcatccccagcatcctgctcatcttgctggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggagcctcggggaacctaccattgctgctgagcctcctctccctgatgcagctcaggaatgtgtcagagcaagaactggacagcgtggccatgaagctccttcaccaagtaagcaagctgtgtgggaagtgcagccccactgacgtggacatcctgcagccctccttcaacttcctgtattggagccttcatcagaccacacccagcagtcagaaaagagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttcaccagacactctctgtggaaatggaccaagtattgaaggctctcagctttccaaagaaaaaggctgcactactctcagctgccatcttatgcttcctgcggacagccctgcgacaaagcttttcctctgccctggtagccctggtgccctcaggggcccagccactgccagccaccaaggacactgtcctagctccactgcgaatgtcgcaagtccggtccctggtcattgggctgcagaacctcctggtgcagaaggaccctctattgtcccaggcctgtgttggctgcctggaggccttgcttgactacctggatgcccggagcccagacattgctctccacgtggcctcccagccttggaatcggtttttgctgtttaccctcttggatgctggagagaattccttcctcagacctgagattttgaggctcatgaccctgtttatgcggtaccggagtagcagtgtcctctctcatgaagaggtgggtgatgttctgcaaggtgtggctttggctgacctgtctaccctctcgaacaccacactccaggccctgcatggcttcttccagcagctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcaca

SEQ ID NO: 152423 - DNA, 874 bp, Homo sapiens
  Payload ID: 9977
  Gene Symbol: MEI1
  Gene Name: meiotic double-stranded break formation protein 1
  Uniprot ID: Q5TIA1
  ENST ID: ENST00000403492
  CDS Start-End: 1-717
atgctggccctcaccttggcaaaggcagattctcccaggactgcactcctctgctctgcctggctgctcactgcctccttctctgcccagcagcacaagggcagtttgcaggttcaccagacactctctgtggaaatggaccaagtattgaaggctctcagctttccaaagaaaaaggctgcactactctcagctgccatcttatgcttcctgcggacagccctgcgacaaagcttttcctctgccctggtagccctggtgccctcaggggcccagccactgccagccaccaaggacactgtcctagctccactgcgaatgtcgcaagtccggtccctggtcattgggctgcagaacctcctggtgcagaaggaccctctattgtcccaggcctgtgttggctgcctggaggccttgcttgactacctggatgcccggagcccagacattgctctccacgtggcctcccagccttggaatcggtttttgctgtttaccctcttggatgctggagagaattccttcctcagacctgagattttgaggctcatgaccctgctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcacata

SEQ ID NO: 152424 - DNA, 346 bp, Homo sapiens
  Payload ID: 9977
  Gene Symbol: MEI1
  Gene Name: meiotic double-stranded break formation protein 1
  ENST ID: ENST00000423900
  CDS Start-End: 1-190
ccggagtagcagtgtcctctctcatgaagagctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcacat

SEQ ID NO: 152425 - DNA, 2326 bp, Homo sapiens
  Payload ID: 9977
  Gene Symbol: MEI1
  Gene Name: meiotic double-stranded break formation protein 1
  ENST ID: ENST00000540833
  CDS Start-End: 806-2326
gcctcagctgagggcaagcgaggagatggctgtgaggcaggcggcgacggcgggcactcccgggcccaggagagaggaagaggcggcgcttctattcgagagggcccattaccggcacgacccgcgctggctgctgcccgtgaccccccgcctgtgcctggcctgcgcgctggagctgctgccggaccccggcgtgtcgttagtgcgcaagaagcacatgttgtcctgcttccaagatgcccttgtgaggcatacctccctggtcacgcaactggtgtctcaggatcagagagtctgcatccacttcataagtgtgctttttggactattatgcagcatggaagatgggagtgtgacagacctctgtattgaagtccttattcagatcacaacgcagctgaagctggagcagactatccgttgcctgctggatgagtgccacaaagagctgtgtaacatgccctccatgcgaggcagcctggccaccctgacccttcttggcaagttggtggatgccatccctgctctggcagacgagcttgtaatggagcatggcaacctgatggagcatctgttgagaggcttagtataccccagtgagggcatacaagcttctgtctgttacctttatgggaagctatactcctcaccagtggcagctgagatgctttcaggacacttccgtgagaagctttttcccctcttcctttccatcctggatggtgcccagacaaaggagctgcagattaactgcttgggtttgctgaggcagctgttgaagtatgatctctttgtgtccatgatcatgaaccaggatggactgggagaaagtgctaagaatatcgaagggtcatcaggaaatacctcactgcctttggtgctcaaaaagcttctcctctctagagatgaaaccctgcaggtggccagtgctcactgtataactgcggtgcttgtccactccccagcaaagcatgcgtcagccttcatccacgctgacatcccagagttcctctttgagcatctttcttcttccagtgaagtgctcgtctggtccagctgtaactgcttgacactcctggtagaagagccactctttttttccaagtgccacacggtgtatgggatcgaggcagtggtgaggagcctgcagggaagcctgaagatgaacaacatagagctgcacaagcagggcctgctgcttttcgctgaaatcctgacccggcagccagaggagatcaagctgttcacaagctcagccatgtgcagagatgctggccgtgccctccaagaagcagttagcagccctgtgctggaggtggctgctgaggccttgaaggccacttctgcttttctgaggaaggaccatcagagcactccacctgtgcagtatggggaactgcaggctttgctagaagccatgctaaaccgatgtgcggagttttcccagaccttgctgagcaggaggcccctgggccatgcctccagtagagattcagagaaggccattcttcaaaggggaaagttcctcctcagcactctggagggatttagaagtgcctgcaggttggctatagaattccagagtgagccttcagcccaggagaatccattcacagctcccagcgccaagaaggaagacaccttggaggccttctcagaatttcttctcagtgcctgtgactcgctgtgtatccccatggtgatgagacacttggagcagaccacccacccagctttgatggaagttttcctctcaattctacataacctctttgtcatcgttccccacatgaaggagaagttttccaagaagcttgcttcctcatccttcatacgactgaccctggagctgaaggccaggttttgcagtggtctgagtcactcagccctaaaccaggtgtgttccaatttcctctactatatgtgcctcaaccttctctcagctccagagaagacaggaccaccttccaaagaagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggtttgtctcagaggcagagttatttgaggctgtgcaaagcttcctcctgtcgctgcaggaccagggcgagcgccccccactggtggtcttcaaagcctccatctatctgcttgcaatctgccaggacaaagacaatacactacgtgagcaacttcattgcagtttgatcagcatttcctaa

SEQ ID NO: 152426 - DNA, 4800 bp, Homo sapiens
  Payload ID: 9978
  Gene Symbol: MEI4
  Gene Name: meiotic double-stranded break formation protein 4
  Uniprot ID: A8MW99
  ENST ID: ENST00000602452
  CDS Start-End: 15-1172
ggacaaaagccaggatggatgttcaaaaatggtatttgagaacttcaaagctggctctggccttggcaattatccgctcaaaaccagcagacaaaagcagcagagaatacacagagcaccttgctatgttgctgtctgaggagcagtcaaaatggagatcaaaagttgaaatcttggaagctgaagttatgcaattacgtcaaaaacttcttgtgagcaggctttgttcaggatcctttaagagtggatacgtttcctcccagttggaggctcaggaacctaagagttctgaaagtacattaacttcgatggaagattctggatgtgatttgtcgaatgagcagagaactgaatcctcagacctgtcccagcactttgtggaaagctgtacccccactcactttccaccactgcctcttgtgaaaagaccttgtgctatcctgcaaaatcctttgtcttctcacatgcaattcttgcaatatctacttgaattaaagaacttgacagaatcaggtaatcttaaaagagacttaacccactttgaaaaagactcttccacagtctctgattctgtttttcaattgctggatggcctgatcactttttaccgtaatcccaaacttcctttttcaagattttggacagaagctgttggtactttagctagtctgatcagtgactataacttatctagtcatattcttaaaaagtgttccaagaagttggaagaatttgagaaaaccctactacatgctattttaggaaacaatcatataaatcagtttcaggtgcagcattatgtctctcagagtctggttaccttgggaaattgcagcttgttgagaaaatctattatatctctgcttctatcagaagtaaatggctttgctgatgatctgggagccatcaatcaggagcaagccagttatgatgtgtcacgctatgaaaacattttctacctgttctgggttctggagcagcttcttcaaaaggaaaccgaagaaggcaacacttcaagtataggtcatgatgaccaagaaatcaagaaatttcttcagaagcatgatgaaactattttccaactttctgatgcatttcctttgtttactttttatttatggagagtgggcattcttttgagctcagcacagatagaaactcttagaaaataactccattccttagcaatttaccacgtttgaagcataataaagtagaatatatgaaaatctcatactgaaaagattttcaatagtattttaattagcattttagaattgatctctaaatataattatcaattcaacttaatggttagtcttaaattgtatgaaattttatgagtcatatttctatactaaaatcagccagtttcggttggtaatgccatccttattcccatgtaactgtatcttatttcactcaatatagtttagctctattattctgtaaaatggaccattaattgtctgtcccttaaaagatattgaagttgtaaaagatttccatataattgatgctaaatggtaatcaaagaaagagatttttaaagaagtttagttgcattatcaacacaaagtgttggaatataagaagtggtcataaatgcaatttttaaaactttttcttacatagttgaacttatatcattgctttcaccttagacgagaatcatatagaagtagaacttttttaacatttggaaacttaattgctttttatttatttcaatttcatatggctaatacatttgtcgagctcttttgaaaatactattaattagttgtttaaaatgttctttgtttttcaacaaatacttgtttcaattctgttaattaaatatgttataatagtcttgtaattgttaaatagtatacaattaagtcactagacatattttataaattctaatatccatctaaaagtgaaatttatagttatttggtggaatttttcagttatacaatttcattgacttcatttcaatgattaaaatcataaccgcaaacttaatgagcatatgttacatttcctatagtgccatttagggaacacaaaatataaatttcctttattaatgatatgtgatggtgtttcataagttaattagcattcctaaatgtcgttggcattaaaagtaatcttgataattccatctacaatgtatatacaattatgtcatctggcacaaacaattatctttggaattatttctagcatttttgaaaagataatgcctttttgataatcctgaaactacatgtatgtcagtcagcttttgttatgtgacagatagataatcaatcacaaaatatctatcagtggcatacaacaataatatttctcagatatatgcaggtcactcaaggatcagctgatttggactggacttgactttaatgaaaagctctgctgaggttgcacataccacaggaataggcttcttgctaaaagtcaggctttcttctcttccacatgtgcatattctgagaaccagacttgggggatagtagcttctcagtggaagctcctctcatggcagtggcaattgagcaagacgaaaggctaggctgagaaatgtcacattagcacttccatccacatgcattgtcaaagtacatcaaatggtcaagcccaaagaaaagtgactgacaggggagtagacttgagtgggagaacttgcagttacagggcaatgagcatggatgtaggtaggtaattattagggccaataatttacttcacaacaagtaccagttgaatacaagaagtatattccaaatcttggattaggagggatttttctaatgtctgattcctgtgaacacctgtgaaggcttatggaagtcacttcagttgatatagcattacacaaaatccactttccatgacaccttcatcttctttcattgtgattaaacaagattggtaaatacacaagtatcagcaatggccctttccctattgcagccagccaacgtaatgatcagctaagagacttttggagctacaacaaatttattaatttcagtggtctccaaggcttcaaggtctgaaaattagcctaggaaatatatttattataaaagaagatgcaagatgttgggatcactgtgaatgcacaaaatggagaaacattttatttccatttggtatccattttatataaacatttaacttccaccaagtatatgatactttaattatcctgggtttcagtctatatcagagtgaatggtgtagtaaattagtattaaggtccaaatctactggtcaaaaagaagataaaatgataaaatgagacatttttatctgtgtttcagtaaagcagtgaattaatgaatgatttaaactggtattacaatgtttaagaatgttataacagtttatatttaggtaatgtctaactttagaattaaggttttagggataagagtaatggagtcagtagtaattgggcagcattgaaactggatataagataggataggaaataaagagaaccatagaatgatcataaaaatgaagcaaataaaaagtgatgataattgctataactcttatactatttaatataagctataataaatatatgataatatattttatatgagagtaaatatatattaaatattttatatacatttatataataaaatatatgaataagtaatattatacatatatatacgatatgtataataaataccaaatagccaggtacttacctaagcattttacatatattaaactgtttgattctcccagcacctgtaatgagaaaggtacgattatttcctgaatctgtattttagagatgaagaactcagaacttgcccaagttcacaacaccaggaagtggcagttaggtttcatcctgaggcagtccatcttccaattccacactcctactttactgcactgcctgttatgtgcagctctcctggcacttcagtaaactttcacaaacacagcttctttgcaattgtcatcaaagctttatacatgcttaactatgaaccttaaggcacaacagtggaaattactagcttatgattagcttattttggattttttaattgctgtaaacaagttgtcctatctataagtaaaccagaggaacagcatctttgaccttttcagggttgtagcatcttgctactcaagactgtagccaagttacagattgtcttcaaacgataatgtcctaaaaggtacagagctccctccagaggtgtttaggtagactgtgaggctgtaatgataagcaaaatggggagagaaaacaaatctgactggtttgttcttggaaaaatatatacgattatctcacaggccttgtactttttaatggtatttgttgtcttttagccaaggtcagcatatttcaagagaggcagggaaacaaggcatttgcatttccaaaattttatgtacatttacagattttctgaacgccatattatggggaaaatattgacagctctgctttattgtaacctaatttcatttattcatcaaatatgaagcaccaattgtctacaaaccaattatttgcaaaaataaaacatactaagctttaacttttgtcagatttatgaaaccaagctttctcttagcagtcaatataatgacccaactacatcaatatttgctgaaggagataattaacttgttaatgtttatctaatattgaaaaaatatataggattttattattgttaaaagttaattgattccgaattatttatagaattgtataatacaaaatttatctggttaataaatatactggtcttg

SEQ ID NO: 152427 - DNA, 1438 bp, Homo sapiens
  Payload ID: 9979
  Gene Symbol: MEIKIN
  Gene Name: meiotic kinetochore factor
  ENST ID: ENST00000616644
  CDS Start-End: 194-1195
gagataaaagcgcgggagcgaggcccggcggctccagttctggggcttttgctttcgctcgattagttgctgtgaggctgctccgcgggcctcgcctggacgctgactccctgtgacttagccctgatcctcaggaaggcaggccatcgagagtccagaggcacccgtggcctgggggtagggtgggatagcaatgtggccgctacgggtctatacccgcaaaaagcgggagggtcagaggctcaatctcaccccgacgccagacctaggctctccagcgaaggccgaggccccgccaggttcgaagagaaaaggcaaagtgcacggcttgtcgaagattgcagagaaagcagagcggagcaggcagggaggtagcggctctgggccgttcagccctcgcttaggagttacaggagagaaaagcctgcaagaaaataggtctagtgaagacacccaggatgagaagattgcatcgttgcgtgaatcagttactgatgacctccaggttgatagtagttcatcaaatagtgaactagtatcaggattaagtttgcaccatggtatggccagttctcttctgagctattcagtcacagactcttatgcagaatacaagagttttgaagagagctttccatcacctgaactgttcagaaaatcagattatttagactgggagtgtcccaacttggaagaacacatgcagtggaagaattctactcttctggataccagtaaagcagtagcgatagagaaggcaccacagttttcaaatgtctcagcaattttcagtacctcttcagaagactatcagaaatgccatagaaaaacagtgatgacagtagcagatcaaaatgtttctccaaaagcaaagtgtgcttcaaattcagaatcagataatgcagcttgtgagattttacttgctgagaaaacttgcccttcaacccctgaaaaaacaaagaaaaaaaaaacaaattccagtactcctggtaagaaaaacagaggccttttaacaagtactccatcttcagagacagctggttttgtgtttcctgcaaatgcatcagaaatatgttgtattattagaacatcaccaggaactagacaagtgaaaaataaaggtgttattgtaaagaagaagaaatattctcttcctaaggatacccctcaagatatcataataaaaatggcatgaaaaaacagctgtggctgaattttcaccactttgaagacaggagtgtgaagtcaaagtctataaagcagaatgtctgcctgaaattatatgaaattaaaaattaaaaattctccagttatttgtgatatatctctatgttgaaattctactgaggttcttgtcatttacttttaatcagttaagaaaaaaaattattccatatgcttcttaaatatatgtatttatattaaaagataaagaacc

SEQ ID NO: 152428 - DNA, 427 bp, Homo sapiens
  Payload ID: 9979
  Gene Symbol: MEIKIN
  Gene Name: meiotic kinetochore factor
  ENST ID: ENST00000439905
  CDS Start-End: 1-314
tgagaaaacttgcccttcaacccctgaaaaaacaaagaaaaaagcaaattgatttgtcctcagtgcaaaaagcatcttttgaagaactatttccaaatgtcagcaattatgttaattcaaatgaaattgttcctgtgtcaagtttgcaggaaaattcttcaaatgagtttcctgcaaatgcatcagaaatatgttgtattattagaacatcaccaggaactagacaagtgaaaaataaaggtgttattgtaaagaagaagaaatattctcttcctaaggatacccctcaagatatcataataaaaatggcatgaaaaaacagctgtggctgaattttcaccactttgaagacaggagtgtgaagtcaaagtctataaagcagaatgtctgcctgaaattatatgaaattaaaaattaaaaattctcc

SEQ ID NO: 152429 - DNA, 1315 bp, Homo sapiens
  Payload ID: 9979
  Gene Symbol: MEIKIN
  Gene Name: meiotic kinetochore factor
  Uniprot ID: A0A087WXM9
  ENST ID: ENST00000442687
  CDS Start-End: 194-1315
gagataaaagcgcgggagcgaggcccggcggctccagttctggggcttttgctttcgctcgattagttgctgtgaggctgctccgcgggcctcgcctggacgctgactccctgtgacttagccctgatcctcaggaaggcaggccatcgagagtccagaggcacccgtggcctgggggtagggtgggatagcaatgtggccgctacgggtctatacccgcaaaaagcgggagggtcagaggctcaatctcaccccgacgccagacctaggctctccagcgaaggccgaggccccgccaggttcgaagagaaaaggcaaagtgcacggcttgtcgaagattgcagagaaagcagagcggagcaggcagggaggtagcggctctgggccgttcagccctcgcttaggagttacaggagagaaaagcctgcaagaaaataggtctagtgaagacacccaggatgagaagattgcatcgttgcgtgaatcagttactgatgacctccaggttgatagtagttcatcaaatagtgaactagtatcaggattaagtttgcaccatggtatggccagttctcttctgagctattcagtcacagactcttatgcagaatacaagagttttgaagagagctttccatcacctgaactgttcagaaaatcagattatttagactgggagtgtcccaacttggaagaacacatgcagtggaagaattctactcttctggataccagtaaagcagtagcgatagagaaggcaccacagttttcaaatgtctcagcaattttcagtacctcttcagaagactatcagaaatgccatagaaaaacagtgatgacagtagcagatcaaaatgtttctccaaaagcaaagtgtgcttcaaattcagaatcagataatgcagcttgtgagattttacttgctgagaaaacttgcccttcaacccctgaaaaaacaaagaaaaaaaaaacaaattccagtactcctggtaagaaaaacagaggccttttaacaagtactccatcttcagagacagctggttttgtgattgatttgtcctcagtgcaaaaagcatcttttgaagaactatttccaaatgtcagcaattatgttaattcaaatgaaattgttcctgtgtcaagtttgcaggaaaattcttcaaatgagtttcctgcaaatgcatcagaaatatgttgtattattagaacatcaccaggaactagacaagtgaaaaataaaggtgttattgtaaagaagaagaaatattctcttcctaaggatacccctcaagatatcataataaaaatggcatga

SEQ ID NO: 152430 - DNA, 968 bp, Homo sapiens
  Payload ID: 9980
  Gene Symbol: MND1
  Gene Name: meiotic nuclear divisions 1
  Uniprot ID: Q9BWT6
  ENST ID: ENST00000240488
  CDS Start-End: 90-707
agtcggcgccaaaatcaaacgcgtcctggcctgtcccgcccctctccccaagcgcgggcccggccagcggaagcccctgcgcccgcgccatgtcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacggaagagcgaaccaggctagcaaaagagctttcttcacttcgagaccaaagggaacagctaaaggcagaagtagaaaaatacaaagactgtgatccgcaagttgtggaagaaatacgccaagcaaataaagtagccaaagaagctgctaacagatggactgataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatcattttattaatgttaaataaagtgtaaaatgcagatgttcttcaccccttttggtagaacaaaagcaggatgataaccatatccccccagtgctcatcaaagtaggacaataaaaatccatccatctcagtccaggcagatttacaaatgatttt

SEQ ID NO: 152431 - DNA, 638 bp, Homo sapiens
  Payload ID: 9980
  Gene Symbol: MND1
  Gene Name: meiotic nuclear divisions 1
  ENST ID: ENST00000504860
  CDS Start-End: 43-540
tcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacggaagagcgaaccaggctagcaaaagagctttcttcacttcgagaccaaagggaacagctaaaggcagaagtagaaaaatacaaagactgtgatccgcaagttgtggaagaaatacgccaagcaaataaagtagccaaagaagctgctaacagatggactggtatgtactataataatgctgataaactatagctaaattcccttcacacttactgcgacgtgaaattcagataccttgtgctagctttgttcaagaaaggacgttaatgaaaaatgtatgcattactcaa

SEQ ID NO: 152432 - DNA, 502 bp, Homo sapiens
  Payload ID: 9980
  Gene Symbol: MND1
  Gene Name: meiotic nuclear divisions 1
  ENST ID: ENST00000508731
  CDS Start-End: 197-502
gtcgatttctgtgaaaacgccccggtttctgccaaagggcaggagtcgctgctcttgtgccgggtgctgctggttgtgtagggcgctgttgcttttttaaggacgctctgcactgaattaggcttcctcgtgggtcatgatcagttaagtcctgtcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacg

SEQ ID NO: 152433 - DNA, 844 bp, Homo sapiens
  Payload ID: 9980
  Gene Symbol: MND1
  Gene Name: meiotic nuclear divisions 1
  ENST ID: ENST00000509752
  CDS Start-End: 58-438
gtcccgcccctctccccaagcgcgggcccggccagcggaagcccctgcgcccgcgccatgtcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcaggaccctggctgctgcttccatgaaataattaaagtctcctattatagaaaattctggctgggcgcagtggctcacgcctgtaatcccagcactttgggaggctgaggcgggcagatcacgaggtgactttcccccacccccacatgaagtgcaagatggagttgtctgagggaagtcaaaagcatgcaagcctacagaaaagcattgagaaagctaaaattggccgatgtgaaacggaagagcgaaccaggctagcaaaagagctttcttcacttcgagaccaaagggaacagctaaaggcagaagtagaaaaatacaaagactgtgatccgcaagttgtggaagaaatacgccaagcaaataaagtagccaaagaagctgctaacagatggactgataacatattcgcaataaaatcttgggccaaaagaaaatttgggtttgaagaaaataaaattgatagaacttttggaattccagaagactttgactacatagactaaaatattcc

SEQ ID NO: 152434 - DNA, 830 bp, Homo sapiens
  Payload ID: 9980
  Gene Symbol: MND1
  Gene Name: meiotic nuclear divisions 1
  ENST ID: ENST00000622785
  CDS Start-End: 90-458
agtcggcgccaaaatcaaacgcgtcctggcctgtcccgcccctctccccaagcgcgggcccggccagcggaagcccctgcgcccgcgccatgtcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacggccaagcaaataaagtagccaaagaagctgctaacagatggactgataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatcattttattaatgttaaataaagtgtaaaatgcagatgttcttcaccccttttggtagaacaaaagcaggatgataaccatatccccccagtgctcatcaaagtaggacaataaaaatccatccatctcagtc

SEQ ID NO: 152435 - DNA, 4291 bp, Homo sapiens
  Payload ID: 9981
  Gene Symbol: MEIS1
  Gene Name: Meis homeobox 1
  Uniprot ID: O00470
  ENST ID: ENST00000272369
  CDS Start-End: 458-1630
atttgaggtgttctgaccagaagaagacagagcggatgatcattcattcaccacgttgacaacctcgcctgtgattgacagctggagtggcagaaagccatgagatttggtagttgggtctgaggggcgctcttttttttccttttctttctttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtcatgctgactccactgcttgaaaaatttgtttactgccccccagatttttaaagattaatacagtaaatataaaaattaattttggctccctaagccatatatgtatttgacaattttaaccgcaaagtaagttgtttaataataaccactgatttctttaagctgacttaatgaactcctaatatcagcaaatttgaggcctaaaggcactaaactaactctagactcagaattacatccaacagaattactcatctaatatcagtgaaattattcttgcacataaaggcaaacctaagtacaaagttaagtcttttactaaaggatgttacctaggatgagcagtatatgtttattaggaaattaactacatgaattgaagagaccagacttcaaaatctaatttttataaatatgctctatgttctcattggataaaactggttattaaccaattttccagaacagctgtacaagatttctgcatggcagccggctaaatggtagaaaataatatgtttaagctggaatagcttataattttatttaaataaaattgctgctataaaaagtgcttcccaaagctaaggaaaatatacaaatattttaattaaggcaaattcgttttaaaaaataagcctttcagtagtgattgctttgtaaacaaaggatgggtcggaggagagagagccttaaactcaagtctgacattcaggcccaagtcaccctataaaccggcccttagcaattctattttctattcgaaaagagaaaccagctgtgggttggctttactaggtgatgtgtgattgactgactcacctgctggagtagcaatgcattctcaccttttgctgatggggccttgtttctaaacacgtggatgcgcagagagcaaggctcagcctactgcagccatctctggcagcgcttctacccctccccagcccatagatgggattgtttaaatctcccttgttgacctagtggcaattcttcctctacctaaatagtcgatgtgagtgaaatcattctcttttgataggtggttgctagcagttaacaaccatttatttactttaacaattaataataaactttataaactgtc

SEQ ID NO: 152436 - DNA, 3530 bp, Homo sapiens
  Payload ID: 9981
  Gene Symbol: MEIS1
  Gene Name: Meis homeobox 1
  Uniprot ID: O00470
  ENST ID: ENST00000398506
  CDS Start-End: 339-1730
gagacatgcccgtttcaccttctaccctcgggagaatgcttctctttctctctttctttcttctttccttcttgccaaaggagcctgaatttctaaactagttgatagggacacaagttagggcaagatcattcatcccagacgagtctcgctgagaattctgtattttttacttaaagctttaattttaaaataagaaaaactcagctttatagatgcaaggccaccgaattccgggtggaaggacccagctgtattgaccttatataagctcggtgccttgccgttctcccatttgcccgcctggcctcctgaaccttctttctctcctgtttgtcatgcagtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccagggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtcatgctgactccactgcttgaaaaatttgtttactgccccccagatttttaaagattaatacagtaaatataaaaattaattttggctccctaagccatatatgtatttgacaattttaaccgcaaagtaagttgtttaataataaccactgatttctttaagctgacttaatgaactcctaatatcagcaaatttgaggcctaaaggcactaaactaactctagactcagaattacatccaacagaattactcatctaatatcagtgaaattattcttgcacataaaggcaaacctaagtacaaagttaagtcttttactaaaggatgttacctaggatgagcagtatatgtttattaggaaattaactacatgaattgaagagaccagacttcaaaatctaatttttataaatatgctctatgttctcattggataaaactggttattaaccaattttccagaacagctgtacaagatttctgcatggcagccggctaaatggtagaaaataatatgtttaagctggaatagcttataattttatttaaataaaattgctgctataaaaa

SEQ ID NO: 152437 - DNA, 363 bp, Homo sapiens
  Payload ID: 9981
  Gene Symbol: MEIS1
  Gene Name: Meis homeobox 1
  ENST ID: ENST00000437869
  CDS Start-End: 1-363
agctttgctttgagagccctgagatttctagaccggtcttcccgtgcctgcagatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaag

SEQ ID NO: 152438 - DNA, 2836 bp, Homo sapiens
  Payload ID: 9981
  Gene Symbol: MEIS1
  Gene Name: Meis homeobox 1
  ENST ID: ENST00000495021
  CDS Start-End: 308-1285
gttgacagtcggccccacggccatggacgtcctttccccaagttagctgagcgcctgccaccgagatcccccgagcctgggcttcgcgcggccgcctaggaggaacccgcaggaaccagccctccccaactctccgcccggcgcctttctcctccaccggatcctggatgtgcagtggaggggacgagggcttgtcgggtgggaaacttaattcaaaatggctgctggaaacgcttgggttttattcgtagcaaatgttgccaatttctccggccagatacgctaaaccgatcctcagataccgtccatggctcagggcctccgacttcagggctccaggaggaaggggagacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtca

SEQ ID NO: 152439 - DNA, 2773 bp, Homo sapiens
  Payload ID: 9981
  Gene Symbol: MEIS1
  Gene Name: Meis homeobox 1
  ENST ID: ENST00000560281
  CDS Start-End: 725-1837
cggaatccacctctccgcctgtgcaacacacactttacacacgcacggggactgcaagcgggcagcatcgatcgtggctcctttaagacaaactcagacagacattttttttaaccctccttctctaatctccttccagtgcagcacttgcaaagagggagagagagggagagaaagaaagagagagagagaagagagaaactgattaggaattaggactgattcaagggaagcgagcgctagggctttgtgcatttgaatattaacatttgaggtgttctgaccagaagaagacagagcggatgatcattcattcaccacgttgacaacctcgcctgtgattgacagctggagtggcagaaagccatgagatttggtagttgggtctgaggggcgctcttttttttccttttctttctttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcaggcaagtcccccatagtgactgtattcaagtcacgcaagcgaaaaccatcctcaagccattcaccgggaggtccgctacctggtaaataaactgggagtgagtataggaacgcctggcaattaaaattaaaccagtttcgtttcataacaacactaatcaatttaacatcattataaaacgtttggagaaggtggaaaaaaaaagccaacagagaaaagtaactcttaaataatatgctcagttacaatattctttgtacacattcaatatattaatgttattttttttctgagtttgccttcccagctctttctgctactatgaccactccctggtgcatggcttggtgtggaattgctgtaaactttattacctgtcaaaagggcaaaggggtcaggattgcttgtgggactcagtaaagttcaaagacattcaatgaggtagagcttttgtgtgctttaataacccaaggcagcttacttctgaagcagcttttcatgtacagttaaaacacgggattcaggtagtggtataaatacatggttcttatttctcagaccttctcttgttaatatccatcttctggtgttcgactttttttttttttaataacagtctttttgttttgtttttaaattatgagcttaaaatggcgatacttctatgggatcctggcttgtggatctaaaaatccaagaaacatctctctaggatttgtttttgcattataatatgccagtaagataacaagagtatttgctaggggtgatgtgagtctttactttctttatgaaatactctctcatctcttagggagcactatggaaaactatgttagcatcgcattgaggcaacacacatttactcctgtaactttttttcttccaacacccattatgtggtcaccagacaaaacccaagcagaaagtttccacaccttaactgttccctctttgagctagatgttttaaaaactcagtcacagaggtgtgtagatctagtctgagagaaatttcactttgaat

SEQ ID NO: 152440 - DNA, 5111 bp, Homo sapiens
  Payload ID: 9981
  Gene Symbol: MEIS1
  Gene Name: Meis homeobox 1
  ENST ID: ENST00000488550
  CDS Start-End: 300-1436
ctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggtaagactttgtttttgtggtagttcctcatttttgactccaagagtgtcatcccctcatcaacacaggtaaatccgcctcatccttttctgttatctcaagctggctgccttgccttgtctgctatctgtgcatctaagatattgcagaggggaagccaggatctttatgcactgaagatctcactatttctcaaccctctagatcctgttttttttttaagggtcttttggcactatctgttgactttgctcattttctggcctcttcttggatttttatctcccttctaggacctatgagtggaatgggcatgaatatgggcatggaggggcagtggcactacatgtaaccttcatctagttaaccaatcgcaaagcaagggggaagtaagtacaaatggggtctttgttttcactttgtcctaggaatatttttcctcttgcattttcttatgttctccttgcccatagcttcatgcttgttcattcctttccattaaactcctggtttcttgcttccatcattttctttttggttgtgatcaagcttttaagcttataaatactgtgtatgatgtacatttatcctgtgtgttgctattgtacagtactgaccacatgacaaaacaagaagcagtcaggaggtgggggagtgggttgtcatagcaacagactgatttgcaaaatgtaagcagtctgcagcagtgcaaggagagggaagagcatgtccccaaagtgtcataaatctgtctaaccgcagttgatgcatgagttacatttctacactaacctgcaagacaccgaaaagctaaacagagacttcttttaggtaaaataaacacaagctttacttagggtaagtaaaggcatattttgagctccagtcaactaaactttgattttttttcttagtttattcctttgtctgtccatcataatgggattacgtgtggcaatgggaaaagggagaatacaaaatagaggtgtgcacagcaggctgcggggcttagcccaggctaattgactatatccaaattaagtatgccatcacttgcagtgtgacaaatggatttgacttattcagtatacaaaaatagagatcattaatgcaatcatcagtggcaggcctagtgaagtgggcctaggaaaactgtcccagattctcactcttgcattttctctcctataaagacactccagcaattcgagttcaaacaagtaaaactgttttgaacaccaaggctcttgttcacttcctaaattacccctaatagcactgttcttgctttgtttttgaaattaaaagcagttatttcagagtcttgcttgtgtctctgattatatttatgcactatttaaaatcactgctgaggccaggggtaattcgtactggtcatcttctctgggtgtgagtcaaatataagtttaacaattagctctgaaaacattccattgagctggggaatgcaacagtcttattacctcatcatggaattctctagcttagttaatttaaatattgtttcttagtttctgggtcaattaaatttaaatgatgtattttatgcttcgtgaccaattaaattactaggttattacaaaaaaaattatcatcttttttgattaaagagctgtgggtacagtatattttataagcaattttcattagttcaaaaatgttcctttaggctagattaagcagccattcattgttagagcctggagaccttattcgaaggtgttcatcgtattcacagtgcactattacttagaactaaagccaattgaacctacttagcaatagcgttatgcctttcacccttgatgattatggagcttatagctctcagaaacaatacacctgtcagtttccatcaactatagcaatccatgcagaagacaagaggccccctcaaagcaggaggggtattgttttaggtccaatttttcttattgttctcaaaatcattataaggtggacagtgttttgtgaagattttcttttccccagctctaagaaaccatgtggaaagaattcattgataactgttttgatttttttctttttttaagtacaggttttgctaagtaatcacccttagtgagcctgtgtagttcagctgcctgtgagatgtttggtgaccagctcagtgtattcttgtattcttgatagagaatatttcaggagacaaaagtgcttcttcagaccagacctcaaataacaattttattctttttaataaataagacctcagtaggcggacctgataacagtgacaatgaaaggaaaatagtggcaaaatgtgagtttccagcatgatgtttctcattttattttcttctgtatgaatcaaaagaatgctttacaaaaccatgttcccttaatcacagggttctctggcttttataggattgtcatagccaggaccacactattgctttttcataacattttctttttgtttctttcttttgaatttcttacagggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaa

SEQ ID NO: 152441 - DNA, 2775 bp, Homo sapiens
  Payload ID: 9982
  Gene Symbol: MEIS2
  Gene Name: Meis homeobox 2
  Uniprot ID: O14770
  ENST ID: ENST00000314177
  CDS Start-End: 256-1164
aggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacagtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgtt

SEQ ID NO: 152442 - DNA, 3056 bp, Homo sapiens
  Payload ID: 9982
  Gene Symbol: MEIS2
  Gene Name: Meis homeobox 2
  Uniprot ID: O14770
  ENST ID: ENST00000340545
  CDS Start-End: 436-1581
ttggctacatcggacccagatgactgcctcctcacttcctccctcccgattccgccgcggcccccaaagactctcggggtggccccttgtccgcaccgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaatacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgattttttgtt

SEQ ID NO: 152443 - DNA, 4829 bp, Homo sapiens
  Payload ID: 9982
  Gene Symbol: MEIS2
  Gene Name: Meis homeobox 2
  Uniprot ID: O14770
  ENST ID: ENST00000338564
  CDS Start-End: 448-1860
accgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaacatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgattttttgttaggcttttgcgtttttaatggttttaggacaagactgcacaatgccaactctatacagtgttaaaagtaggtttttccccccagcagttgagtatattttaaactcatcaataatttttaaggtaatcatctatagcctttcaatgtctatttgacctataagttccaccagcagaaaacttctaaaggtacgaaactatgtgtacatgatgagccaggttgaaagatccccttgaacatgctcaacctcctttttagatgcatgacgttaaaaaatatatactttcagataaagcttttcatgggcatcctctgccagaataaaggacttttcagggttaattttacaacataagaaataatgtctgtgctcaaaggtaatttatctgcctgtgtttttcctctgcctgtcttactacaatattgttggatatgtaaatgaaaatttacatatgggtgttcatagataagtaaacaacttctatggagtttgaaattctgactttaaaagattacttaatcattaatattttataaattatattgtggtatatttttatttcagacacatccatgtgcagggatgctagtgtgatgatttgataactaaacttaaacttttttctgaaaacaaaacaaaacaaaatggacggtataatgccattttcaaaattttatgcaacattcctggaaatctataccattagcttattgatactgcacaaacaatgtctgctaaagtgtgcaaaaagggtgaggcatgtcccctcaattttcaaataaatatactatcctggaattttttaactcttaaattttgaatctttgtttagaaagaataatgtcatatactttggctagatatgtgatgtcaaccggctaaggaaattattcatcatctctgcaaacttaaacttggaagaaatccatagttattatttggggctcttccatctttccatttcagacagcatttatggaggttctatataaatgaacgaggaaatacacttctattgttttgtgttatatttagtcaggtagaatttttacaaatacatttcagtttaagtgttgtgttgctgtttaaacatagaaataatgcttctgacacaaactaacttaatagagaaattcagtgccacttgggaaagagagatagcttccctctcatttttgctattctattttacatgaagtctttttgtaaattttaaatatttgcctatttttactttaaatacttttatgtaaactatgaaaattccccattataaatcaactctcacatcaggtgggaaaaagaacctttttttctttccactcagtaaattctgaagggtttccttggcaattggctcgtgtttaggatgtgttttatgcaattatcaagttatctcattgaagtttagagaccagagctctcaactcttggttttaatgaataaagtcatctcatgcttagtttattcgtcaaacccacgtcctatcatgttaactttaaccttcttaaatatttggagatgaatgataattgtaatatttgtttgcattaccttgctctcccccacccccaaccccatgataacacagagaagtgatagatttgtccaatttttataatgctttttttacaccaccccggaaggcacttgctcctatctcgggtttactatttagtgtaaagagttccgatttgggtatatttaagaaagactcagctgtcaaaagcaaagaaactgggaatggtgttttgacaaccatatagtgttaaaggaaatactgtagtctgaataaaattgcttatgttctccaaaa

SEQ ID NO: 152444 - DNA, 2295 bp, Homo sapiens
  Payload ID: 9982
  Gene Symbol: MEIS2
  Gene Name: Meis homeobox 2
  Uniprot ID: O14770
  ENST ID: ENST00000397620
  CDS Start-End: 726-1646
cccgatgcctcctctcccttcaacgcttctgctgctgctcgctgcttgatgatggcggccagtattttaaaaaatagcaaaattattcatcggcttctttccctcccgtgcctctgcgtgtgtgcgagtgtgtgtgcgtgcgtgtgtgcgtgtctgggcgcgcgtgttccagcgctgtgcgagcgggcgggcggcgagtgcgtgtgagtggtgtgtgtgtgtgcgtgtgcaatcgttacacgctttcgcctcgctccagcttttaccccagcagcgcgattcccccggttctcctgctgccgctgctgcgccgctgccgccgtggctcgcgcggctcggggcgggcacgggctgcgtaggagccgccgccggggccgccgctggggccgcgctgccgcagccgctgcgccgccgcctagactactagcctgggctgcttgttttgtctctgaaattgacaaggacgcagggaatccgctgctaaataatgtttctgtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatggctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttag

SEQ ID NO: 152445 - DNA, 2748 bp, Homo sapiens
  Payload ID: 9982
  Gene Symbol: MEIS2
  Gene Name: Meis homeobox 2
  Uniprot ID: O14770
  ENST ID: ENST00000397624
  CDS Start-End: 352-1272
catctttatcccttcctctcttttctgttcgccctcttctccctgctctttttccctttccacccccctcctctgttctccctcacctcctgcgccccctcccccttcccgggttctgacagtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatggctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgattttttgtta

SEQ ID NO: 152446 - DNA, 2917 bp, Homo sapiens
  Payload ID: 9982
  Gene Symbol: MEIS2
  Gene Name: Meis homeobox 2
  Uniprot ID: O14770
  ENST ID: ENST00000424352
  CDS Start-End: 1065-2270
ggctcggcgcggcgcgctcctcctcgctcccgctccccactcccgggatgtgtctccgccgtacgacgggctatggccaccacgacttccgggttccgtcatttcgttctcccgccgccgacccgcgccgccaaactgaggctcttcaataagccaggcagcagccaacctgccaacacctactgacactcactcatctcccagagagagaaagagagcgagagagagcgagcgcgagagagcgagcgcgagtgagagcgagcgagcgagcgagaaagagagagagggagagacaaaatacctaccaggaaagggggggaggaagtccaatttttgcaaactattcatttttttttcttgatttttctcactgctttctttgaacaatactttaaagagagaggatcgtattatagataccgcgggggcaaagctaaaaaaggggggaggggggaggaaaaaattcaagaagcagaaacccctcgcggagttttactggaagaaaaaaacgggtctgaaagattcctcctcttcatcatcatcaaccatcattcattcactaccttgacattccgggctttgattgacagctggagtggcaaaaagccatgaaacacgacagttcggttacatgtgggctgctgacgggccgctcgtaaccttcagttcgggggcttgacaatttttttcttctttttcttctttttcttttctttctttttttttccaactgaggggaagagaagagaaagagggggaaaggaggaccgaagaggaggaggaggggaggggggaggaggaggaggtggaggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagtttt

SEQ ID NO: 152447 - DNA, 2666 bp, Homo sapiens
  Payload ID: 9982
  Gene Symbol: MEIS2
  Gene Name: Meis homeobox 2
  Uniprot ID: O14770
  ENST ID: ENST00000557796
  CDS Start-End: 434-1579
cggcttctttccctcccgtgcctctgcgtgtgtgcgagtgtgtgtgcgtgcgtgtgtgcgtgtctgggcgcgcgtgttccagcgctgtgcgagcgggcgggcggcgagtgcgtgtgagtggtgtgtgtgtgtgcgtgtgcaatcgttacacgctttcgcctcgctccagcttttaccccagcagcgcgattcccccggttctcctgctgccgctgctgcgccgctgccgccgtggctcgcgcggctcggggcgggcacgggctgcgtaggagccgccgccggggccgccgctggggccgcgctgccgcagccgctgcgccgccgcctagactactagcctgggctgcttgttttgtctctgaaattgacaaggacgcagggaatccgctgctaaataatgtttctgtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaa

SEQ ID NO: 152448 - DNA, 552 bp, Homo sapiens
  Payload ID: 9982
  Gene Symbol: MEIS2
  Gene Name: Meis homeobox 2
  ENST ID: ENST00000560697
  CDS Start-End: 270-552
gttgattacagttcttgctccttcccctctgcaccccgtctctgtgtgtgtgtctctgcgtggcgctgcccgttaggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatg

SEQ ID NO: 152449 - DNA, 605 bp, Homo sapiens
  Payload ID: 9982
  Gene Symbol: MEIS2
  Gene Name: Meis homeobox 2
  ENST ID: ENST00000560617
  CDS Start-End: 291-605
ggaagatggctggaaattattttatattctgagagcacttggcgaggggtgagatgcacgatcctaacgtgtaccacacgagctcttccggctgagggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaa

SEQ ID NO: 152450 - DNA, 2538 bp, Homo sapiens
  Payload ID: 9982
  Gene Symbol: MEIS2
  Gene Name: Meis homeobox 2
  Uniprot ID: O14770
  ENST ID: ENST00000559085
  CDS Start-End: 131-1297
cttttctgttcgccctcttctccctgctctttttccctttccacccccctcctctgttctccctcacctcctgcgccccctcccccttcccgggttctgacagtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattg

SEQ ID NO: 152451 - DNA, 2321 bp, Homo sapiens
  Payload ID: 9982
  Gene Symbol: MEIS2
  Gene Name: Meis homeobox 2
  ENST ID: ENST00000560570
  CDS Start-End: 17-313
attggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattg

SEQ ID NO: 152452 - DNA, 1442 bp, Homo sapiens
  Payload ID: 9982
  Gene Symbol: MEIS2
  Gene Name: Meis homeobox 2
  Uniprot ID: O14770
  ENST ID: ENST00000559561
  CDS Start-End: 256-1440
aggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaacc

SEQ ID NO: 152453 - DNA, 1088 bp, Homo sapiens
  Payload ID: 9982
  Gene Symbol: MEIS2
  Gene Name: Meis homeobox 2
  ENST ID: ENST00000558313
  CDS Start-End: 618-1088
tgactgcctcctcacttcctccctcccgattccgccgcggcccccaaagactctcggggtggccccttgtccgcaccgcttggagggagtgtgctctgagttaagctggtctcttctggtcctggaaaaaaatgagtattgacaaggttgctggatctgcgcagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaatacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatggctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcgga

SEQ ID NO: 152454 - DNA, 4822 bp, Homo sapiens
  Payload ID: 9982
  Gene Symbol: MEIS2
  Gene Name: Meis homeobox 2
  Uniprot ID: O14770
  ENST ID: ENST00000561208
  CDS Start-End: 420-1853
cgggccgctcgtaaccttcagttcgggggcttgacaatttttttcttctttttcttctttttcttttctttctttttttttccaactgaggggaagagaagagaaagagggggaaaggaggaccgaagaggaggaggaggggaggggggaggaggaggaggtggaggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgattttttgttaggcttttgcgtttttaatggttttaggacaagactgcacaatgccaactctatacagtgttaaaagtaggtttttccccccagcagttgagtatattttaaactcatcaataatttttaaggtaatcatctatagcctttcaatgtctatttgacctataagttccaccagcagaaaacttctaaaggtacgaaactatgtgtacatgatgagccaggttgaaagatccccttgaacatgctcaacctcctttttagatgcatgacgttaaaaaatatatactttcagataaagcttttcatgggcatcctctgccagaataaaggacttttcagggttaattttacaacataagaaataatgtctgtgctcaaaggtaatttatctgcctgtgtttttcctctgcctgtcttactacaatattgttggatatgtaaatgaaaatttacatatgggtgttcatagataagtaaacaacttctatggagtttgaaattctgactttaaaagattacttaatcattaatattttataaattatattgtggtatatttttatttcagacacatccatgtgcagggatgctagtgtgatgatttgataactaaacttaaacttttttctgaaaacaaaacaaaacaaaatggacggtataatgccattttcaaaattttatgcaacattcctggaaatctataccattagcttattgatactgcacaaacaatgtctgctaaagtgtgcaaaaagggtgaggcatgtcccctcaattttcaaataaatatactatcctggaattttttaactcttaaattttgaatctttgtttagaaagaataatgtcatatactttggctagatatgtgatgtcaaccggctaaggaaattattcatcatctctgcaaacttaaacttggaagaaatccatagttattatttggggctcttccatctttccatttcagacagcatttatggaggttctatataaatgaacgaggaaatacacttctattgttttgtgttatatttagtcaggtagaatttttacaaatacatttcagtttaagtgttgtgttgctgtttaaacatagaaataatgcttctgacacaaactaacttaatagagaaattcagtgccacttgggaaagagagatagcttccctctcatttttgctattctattttacatgaagtctttttgtaaattttaaatatttgcctatttttactttaaatacttttatgtaaactatgaaaattccccattataaatcaactctcacatcaggtgggaaaaagaacctttttttctttccactcagtaaattctgaagggtttccttggcaattggctcgtgtttaggatgtgttttatgcaattatcaagttatctcattgaagtttagagaccagagctctcaactcttggttttaatgaataaagtcatctcatgcttagtttattcgtcaaacccacgtcctatcatgttaactttaaccttcttaaatatttggagatgaatgataattgtaatatttgtttgcattaccttgctctcccccacccccaaccccatgataacacagagaagtgatagatttgtccaatttttataatgctttttttacaccaccccggaaggcacttgctcctatctcgggtttactatttagtgtaaagagttccgatttgggtatatttaagaaagactcagctgtcaaaagcaaagaaactgggaatggtgttttgacaaccatatagtgttaaaggaaatactgtagtctgaataaaattgcttatgttctccaaaa

SEQ ID NO: 152455 - DNA, 545 bp, Homo sapiens
  Payload ID: 9982
  Gene Symbol: MEIS2
  Gene Name: Meis homeobox 2
  ENST ID: ENST00000606653
  CDS Start-End: 1-420
atacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaagaatttttcagatttatccccattttccagatgaagtggcttggccttggagagggtcagttacttgactgtcacgatagaaagaggaagcagaagaatgaagacaaagccatttaaaattttcttgttctttaccttttgcataaaaggtattcagttcacaaatgatgtaaaatttaattaaggcaagtgactgtcctgagaaagtcattaaaaccctcatgtcatttctctaatcaaaa

SEQ ID NO: 152456 - DNA, 705 bp, Homo sapiens
  Payload ID: 9982
  Gene Symbol: MEIS2
  Gene Name: Meis homeobox 2
  ENST ID: ENST00000607277
  CDS Start-End: 1-705
gaaggatttcgctggatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggt

SEQ ID NO: 152457 - DNA, 2104 bp, Homo sapiens
  Payload ID: 9983
  Gene Symbol: MEIS3
  Gene Name: Meis homeobox 3
  ENST ID: ENST00000331559
  CDS Start-End: 443-1657
gaccgggaacggggagcgcggctgccagcacccctgagccgccgccggaccctccgtcgccccgggccgccccccgccccctgcggtccccggtgtgtccgtctcgggacggttcgattccctccagagccggggaagggacggggggggcccagaggagggggcctcgggcgccccgcctgcgcctgctgcccccgccccggcggcgatgcgctcctggccgtgacccccgctgggggcgggggccggggtccatgcgcggagtccccacccggcccggcgcctgccgctgacggcggcgggggtgggggggcgcgcgcctggcctcctgcccaccccctggcgtcaacaccgcgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgagacgctcagaagcgccggttctcccagacgtctgcctgggcctgggctccccatcccccggaccccggtgggccagaccttggggttcagactgcggccggccaggcaggcagagtgactcttgctggtggctgcagcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgga

SEQ ID NO: 152458 - DNA, 1758 bp, Homo sapiens
  Payload ID: 9983
  Gene Symbol: MEIS3
  Gene Name: Meis homeobox 3
  Uniprot ID: Q99687
  ENST ID: ENST00000441740
  CDS Start-End: 235-1311
atgcgctcctggccgtgacccccgctgggggcgggggccggggtccatgcgcggagtccccacccggcccggcgcctgccgctgacggcggcgggggtgggggggcgcgcgcctggcctcctgcccaccccctggcgtcaacaccgcgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgga

SEQ ID NO: 152459 - DNA, 1828 bp, Homo sapiens
  Payload ID: 9983
  Gene Symbol: MEIS3
  Gene Name: Meis homeobox 3
  Uniprot ID: Q99687
  ENST ID: ENST00000559524
  CDS Start-End: 42-1307
aggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgagacgctcagaagcgccggttctcccagacgtctgcctgggcctgggctccccatcccccggaccccggtgggccagaccttggggttcagactgcggccggccaggcaggcagagtgactcttgctggtggctgcagcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagaggtgtgagggtctaagggctggggattgtgcaattctcaaacctccattagacctcaggactccaagagtgggcacttccagagtagtgggtcagcctgggtccctgtactgtgggttctctgaggcttgatgggaagatattcatccatctgtccgtccgtccatccatccatccatccatccatcctcctcctccatgtatccatccatctacccactcactcacccatccatatctttatccatccgttactcaattactcattcacccgcaatccatccatccaaacctagtccacccacctacccactcattacccatctgaccacacattcacccactcactccattcatctctccactcgccaacccactcatccatctacctccacactgaccaaccacccacacatctacccatttatctgtgcattcacccacctccctacccaggcttccacccacctacccatcaactcacccatccatccacccacacatcc

SEQ ID NO: 152460 - DNA, 532 bp, Homo sapiens
  Payload ID: 9983
  Gene Symbol: MEIS3
  Gene Name: Meis homeobox 3
  ENST ID: ENST00000559338
  CDS Start-End: 1-532
ccggcctctctcttccctcccaggttcgctctgagaggcccctcttctcctccaacccagaactggacaatctgggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgagacgctcagaagcgccggttctcccagacgtctgcctgggcctgggctccccatcccccggaccccggtgggccagaccttggggttcagactgcgg

SEQ ID NO: 152461 - DNA, 1918 bp, Homo sapiens
  Payload ID: 9983
  Gene Symbol: MEIS3
  Gene Name: Meis homeobox 3
  Uniprot ID: Q99687
  ENST ID: ENST00000561293
  CDS Start-End: 208-1473
ggggcgggggccggggtccatgcgcggagtccccacccggcccggcgcctgccgctgacggcggcgggggtgggggggcgcgcgcctggcctcctgcccaccccctggcgtcaacaccgcgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgagacgctcagaagcgccggttctcccagacgtctgcctgggcctgggctccccatcccccggaccccggtgggccagaccttggggttcagactgcggccggccaggcaggcagagtgactcttgctggtggctgcagcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacg

SEQ ID NO: 152462 - DNA, 1199 bp, Homo sapiens
  Payload ID: 9983
  Gene Symbol: MEIS3
  Gene Name: Meis homeobox 3
  ENST ID: ENST00000560245
  CDS Start-End: 1-753
ccgcccccgtccctgagcacccccgccctgcccccgtgggtggccccccccagtaccccggtgcccccccaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgg

SEQ ID NO: 152463 - DNA, 1883 bp, Homo sapiens
  Payload ID: 9983
  Gene Symbol: MEIS3
  Gene Name: Meis homeobox 3
  ENST ID: ENST00000561096
  CDS Start-End: 46-1437
ttatctgccaactgtgaaatgaaatagaagacagggaggcttcgtatgtgtactttgtgtacaacaatgcgcggttcctacaggaggtgtccatggatctccctctctgtctgtctctctctctgtctctgtcactgtcttctcacgccactttctccatctcttttccctcccagccagaccctgccgtctctccctctgggtcctcctgcccacatgtcaggaatctctgcctggacggggtcctcactccccaccgaggcagctccaggggacctggagggcttcaagcttgggggctcagacacctggggaccacagtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgg

SEQ ID NO: 152464 - DNA, 1715 bp, Homo sapiens
  Payload ID: 9983
  Gene Symbol: MEIS3
  Gene Name: Meis homeobox 3
  Uniprot ID: Q99687
  ENST ID: ENST00000558555
  CDS Start-End: 189-1316
atgcgcggagtccccacccggcccggcgcctgccgctgacggcggcgggggtgggggggcgcgcgcctggcctcctgcccaccccctggcgtcaacaccgcgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctccc

SEQ ID NO: 152465 - DNA, 378 bp, Homo sapiens
  Payload ID: 9983
  Gene Symbol: MEIS3
  Gene Name: Meis homeobox 3
  ENST ID: ENST00000607695
  CDS Start-End: 1-378
ttccccaaggtggccaccaacatcatgcgagcctggttgttccagcacctctcggcgggggctggcaggcatgtaattgccccaagcctgaggctcccttggtctccatcctggggagcgcagagacgctcagaagcgccggttctcccagacgtctgcctgggcctgggctccccatcccccggaccccggtgggccagaccttggggttcagactgcggccggccaggcaggcagagtgactcttgctggtggctgcagcacccgtacccctcggaggagcagaagaaacagctggcgcaggacacggggctcaccatcctgcaagtcaacaactggttcattaacgcccggagacgcatcgtgcaacctatgatc

SEQ ID NO: 152466 - DNA, 733 bp, Homo sapiens
  Payload ID: 9983
  Gene Symbol: MEIS3
  Gene Name: Meis homeobox 3
  ENST ID: ENST00000557833
  CDS Start-End: 72-733
cggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtgagcgcgtctcacctccccacaccctcacttgcccctgtcatcccaccccctctcgtcgcctctgccccccaccttccagctctctccccaccggagttgaagcagaatgccgcccccgtccctgagcacccccgccctgcccccgtgggtggccccccccagtaccccggtgcccccccaggtccacgacctgtgcgacaacttctgtcacc

SEQ ID NO: 152467 - DNA, 1000 bp, Homo sapiens
  Payload ID: 9984
  Gene Symbol: MLANA
  Gene Name: melan-A
  Uniprot ID: Q16655
  ENST ID: ENST00000381471
  CDS Start-End: 407-763
ctctcattaaggaaggtaagagcgttgccttctcgccataatcatagtcctcttctcccagaataggatttgggaaattctggctaagtcctctgcctaccctcattgccccgctgatgtgtgacatcaacagaatttctccgcaacgtttgtcagtctccaacctcagagggctcacaaagcctcctcctgaatcctctctcagtcctccaacactaccaagaagaaaagcaattattcaggatggcatcttgctggggagaagcagcctccctgaggtagatgtgttctcctgtcacttaaagaaccacttctcctggtctgagtagtaagaggcgcatttgctgttgctgcaccatttgccaaggctctgagtttgaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatact

SEQ ID NO: 152468 - DNA, 791 bp, Homo sapiens
  Payload ID: 9984
  Gene Symbol: MLANA
  Gene Name: melan-A
  Uniprot ID: Q16655
  ENST ID: ENST00000381476
  CDS Start-End: 200-556
cagcagacagaggactctcattaaggaagaatttctccgcaacgtttgtcagtctccaacctcagagggctcacaaagcctcctcctgaatcctctctcagtcctccaacactaccaagaagaaaagcaattattcaggatggcatcttgctggggagaagcagcctccctgaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgata

SEQ ID NO: 152469 - DNA, 2415 bp, Homo sapiens
  Payload ID: 9984
  Gene Symbol: MLANA
  Gene Name: melan-A
  Uniprot ID: Q16655
  ENST ID: ENST00000381477
  CDS Start-End: 161-517
ccgtcagaaatctaaacccgtgactatcatgggactcaaaaccaggaaaaaaaataagtcaaaacgattaagagccagagaagcagtcttcatacacgcggccagccagcagacagaggactctcattaaggaaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatactatctgtgccagaggtaatgttagtaaatccatggtgttattttctgagagacagaattcaagtgggtattctggggccatccaatttctctttacttgaaatttggctaataacaaactagtcaggttttcgaaccttgaccgacatgaactgtacacagaattgttccagtactatggagtgctcacaaaggatacttttacaggttaagacaaagggttgactggcctatttatctgatcaagaacatgtcagcaatgtctctttgtgctctaaaattctattatactacaataatatattgtaaagatcctatagctctttttttttgagatggagtttcgcttttgttgcccaggctggagtgcaatggcgcgatcttggctcaccataacctccgcctcccaggttcaagcaattctcctgccttagcctcctgagtagctgggattacaggcgtgcgccactatgcctgactaattttgtagttttagtagagacggggtttctccatgttggtcaggctggtctcaaactcctgacctcaggtgatctgcccgcctcagcctcccaaagtgctggaattacaggcgtgagccaccacgcctggctggatcctatatcttaggtaagacatataacgcagtctaattacatttcacttcaaggctcaatgctattctaactaatgacaagtattttctactaaaccagaaattggtagaaggatttaaataagtaaaagctactatgtactgccttagtgctgatgcctgtgtactgccttaaatgtacctatggcaatttagctctcttgggttcccaaatccctctcacaagaatgtgcagaagaaatcataaaggatcagagattctggaatggtgtcattatttgcatagcaacattgcaatttgttttcctttggctacatcaacgtatcacctacactattatttatctaatatttctctttcaggcagctcatttaaactttttttggctttaattcctattgccatcctgagtggaaaaccagtatcattttccatagtagaggataactataacaacgaagataatgaaagtaatttttttaacctaagaaaatactaatggtcacagaaggctatgaacctgagacctgctctctttgtcaaacagagattaacaaggatcagagaaaagttaaaggctgtctttgacataactggaaggcttacaagagttttaaagaaattactttctcactatatgattcattgctatttaacggtgagtcagtaaaccacctaaaaatcatcttgtctcatcagaaacactagtgtaacataactgcatcattttctactaaagacaaaatttcaccaaaggggaaaaagaaaacacaggataaagagatgtattacacacatcgaaaaaaacaacatttaacaaaatattaaaatatttccccactcttctgatactgtcaagtcttactacttaaaataaggcttccacctctcccacttcaaacaaataaatgaattctaaaccaaagaaacttcatcaggcatttgggtacctcctcccctcaccacgaggtctctgctgaacctcaatcctgtacactgaggaacctgtggcttgaaccctacatccctccagaacccccagactg

SEQ ID NO: 152470 - DNA, 2851 bp, Homo sapiens
  Payload ID: 9985
  Gene Symbol: MCHR1
  Gene Name: melanin-concentrating hormone receptor 1
  Uniprot ID: Q99705
  ENST ID: ENST00000249016
  CDS Start-End: 697-1965
cagatatttgtctcaaagagtcccaggccaaacctcagggacctcagagcgtttagaaaaataacacctctgtgagcttggtccaggcagatcccatgcagagaggagtttgtccccttccagtccccgaggtcctggctattgccagcatggagtgacctgtgtcacctctgagtgccaggcaagggttcagcagctgacgactcagcttctgcaggatgctggcagcatagccagcgagatagttggaagccgtcagggcacagggaaggggccgagggtgccctgagtgtgcatggggggcagccctgctgcagtccaagcctttgattcccaagctatgtgcacagtttcctctggactctgccatgtggcccagccacccatacctggaataggggctaagccaagctgctctctcctccaaagggaggcagcctgtgtgctttgtccgtttgcctttgcagagacctcgatcttcacgcaaggcaagcagcagcccctgtaagcacacgagacaatcccaagtgtcagtgggaaggagatccctttcctgatggggctgcctgtgtccagtccctcccagcttccccagggccctggggctctgcaggcattcagaagtggaagccagccacagcctgggactgaagaggttaatgtgcatctgcctccgaatgttaatgtgtctaggtgatgtcagtgggagccatgaagaagggagtggggagggcagttgggcttggaggcggcagcggctgccaggctacggaggaagacccccttcccaactgcggggcttgcgctccgggacaaggtggcaggcgctggaggctgccgcagcctgcgtgggtggaggggagctcagctcggttgtgggagcaggcgaccggcactggctggatggacctggaagcctcgctgctgcccactggtcccaacgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctgatacttcccctgccaccctgcacacctccaagtcagggcaccacaacacgccaccgggagagatgctgagaaaaacccaagaccgctcgggaaatgcaggaaggccgggttgtgaggggttgttgcaatgaaataaatacattccatggggctcacacgttgctggggaggcctggagtcaggtttggggttttcagatatcagaaatccccttgggggagcaggatgagacctttggatagaacagaagctgagcaagagaacatgttggtttggataaccggttgcactatatctgtgagctctcaaatgtcttcttcccaaggcaagaggtggaagggtactgactgggtttgtttaaagtcaggcagggctggagtgagcagccagggccatgttgcacaaggcctgagagacgggaaagggcccgatcgctctttcccgcctctcactggtgcgatggaaggtggcctttctcccaagctggtggataatgaaaaataaagcatcccatctctcggcgttccagcatcctgtcaatttcccttttgctctagaggatgcatgtttatttgaggggatgtggcactgagcccacaggagtaaaagcccagtttgctaggaggtctgcttactgaaaacaaggagacctggggtgggtgtggttgggggtcttaaaactaataaaagctggggtcggggggcttttgcagctctggtgacattctctccacggggcacatttgctcagtcactaatccagcttgagtgtccgtgtgttctgcatgtgcaggggtcattctagtgcccggtgtgttggcatcatctttttgctctagcccttcctctccaaaataaaatcaaataaaggaaaatctccacccaca

SEQ ID NO: 152471 - DNA, 1219 bp, Homo sapiens
  Payload ID: 9985
  Gene Symbol: MCHR1
  Gene Name: melanin-concentrating hormone receptor 1
  ENST ID: ENST00000381433
  CDS Start-End: 174-1064
ccaagtgtcagtgggaaggagatccctttcctgatggggctgcctgtgtccagtccctcccagcttccccagggccctggggctctgcaggcattcagaagtggaagccagccacagcctgggactgaagaggttaatgtgcatctgcctccgaatgttaatgtgtctaggtgatgtcagtgggagccatgaagaagggagtggggagggcagttgggcttggaggcggcagcggctgccaggctacggaggaagacccccttcccaactgcggggcttgcgctccgggacaaggtggcaggcgctggaggctgccgcagcctgcgtgggtggaggggagctcagctcggttgtgggagcaggcgaccggcactggctggatggacctggaagcctcgctgctgcccactggtcccaacgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcgtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctgatacttcccctgccaccctgcacacctccaagtcagggcaccacaacacgccaccgggagagatgctgagaaaaacccaagaccgctcgggaaatgcaggaaggccgggttgtgaggggttgttgcaatgaaataaatacattccatggggctcac

SEQ ID NO: 152472 - DNA, 2368 bp, Homo sapiens
  Payload ID: 9986
  Gene Symbol: MCHR2
  Gene Name: melanin-concentrating hormone receptor 2
  Uniprot ID: Q969V1
  ENST ID: ENST00000281806
  CDS Start-End: 316-1338
agaaaagagcacgacgcacccgatgctcggattggatgaagtggcaaaggtaaccccgctggttcgggcgtttggctgttcctgtgcctggacccccgctttggaaatggaggtggggctggctcccaacctgtctcagagaccctcgcactcctcccccaccttccgtcagctgggacccgctgagagccgtttttggtcacgcgcgcttagcggatagacctgcagtcccgcagagaggaagggcgcccgggctgtccgccgcgcggggaggacgcgagcacccagctttaatccctggaaagtccacgaacaatgaatccatttcatgcatcttgttggaacacctctgccgaacttttaaacaaatcctggaataaagagtttgcttatcaaactgccagtgtggtagatacagtcatcctcccttccatgattgggattatctgttcaacagggctggttggcaacatcctcattgtattcactataataagatccaggaaaaaaacagtccctgacatctatatctgcaacctggctgtggctgatttggtccacatagttggaatgccttttcttattcaccaatgggcccgagggggagagtgggtgtttggggggcctctctgcaccatcatcacatccctggatacttgtaaccaatttgcctgtagtgccatcatgactgtaatgagtgtggacaggtactttgccctcgtccaaccatttcgactgacacgttggagaacaaggtacaagaccatccggatcaatttgggcctttgggcagcttcctttatcctggcattgcctgtctgggtctactcgaaggtcatcaaatttaaagacggtgttgagagttgtgcttttgatttgacatcccctgacgatgtactctggtatacactttatttgacgataacaactttttttttccctctacccttgattttggtgtgctatattttaattttatgctatacttgggagatgtatcaacagaataaggatgccagatgctgcaatcccagtgtaccaaaacagagagtgatgaagttgacaaagatggtgctggtgctggtggtagtctttatcctgagtgctgccccttatcatgtgatacaactggtgaacttacagatggaacagcccacactggccttctatgtgggttattacctctccatctgtctcagctatgccagcagcagcattaacccttttctctacatcctgctgagtggaaatttccagaaacgtctgcctcaaatccaaagaagagcgactgagaaggaaatcaacaatatgggaaacactctgaaatcacacttttaggaaagtacatggatcaccatgagtctagacatgattgtctatcttactggtattatcagaaagggcaggtgtaccgatatgtttatgcccattcttcttgtgtacttgtgactcttagcagcatggaagagaagtgtaaccatgcaaatacaatgagcttaatatgctaactttagcaagatgtaaaatgttgatctatattgtgggtagggaatgggatagtctgagatacccaggcttcatgatggtgtatattatttcagcatattataaactagtcactaatgaaaatggccatccatgaccattgactcaaaactcaccaaggaacctgaccttgccctccacactgtggcctcactgtaacagtttcctcaaggttcctaggagggtatcaccttagagtgaagtctaaaatttggctattttttatctataaaaaatgtcagttttatatggtccaatactaataccctcaacaactaagccccaccttttagaataagttaccatttattgcacacatgcaatgtgtaagattacatgtaacaaacctgtgaaataagtattattacctttgtttgctaaggctcagaaaggagaaatgataggcctaatgctgcaacagctatctaagagctgagctaacattcagctctgcctgtttcttttctactgcacgaccttgacaacctttacttatcatactggagaacccagtaacttggagtttcttttgctttctcctgtagccctacaagaggagaactaaagtctgatagaaatgagttgatgttttaagcatcattttggattatctttgttctcacacctgctaactgtagaaactggcatctgcactttaataataatactttacttctggactttaagcataattaggaaacattcctggccgggtgcagtggctcatgcctgtaatcccagcactttgggaggtggaggcaggtggatcacaaagtcagaagttcaagaccagtctggccaacatagtgagaccctgtctact

SEQ ID NO: 152473 - DNA, 1311 bp, Homo sapiens
  Payload ID: 9986
  Gene Symbol: MCHR2
  Gene Name: melanin-concentrating hormone receptor 2
  Uniprot ID: Q969V1
  ENST ID: ENST00000369212
  CDS Start-End: 101-1123
ttcgcgaaggcaccccacgctcctagaaaagagcacgacgcacccgatgctcggattggatgaagtggcaaagctttaatccctggaaagtccacgaacaatgaatccatttcatgcatcttgttggaacacctctgccgaacttttaaacaaatcctggaataaagagtttgcttatcaaactgccagtgtggtagatacagtcatcctcccttccatgattgggattatctgttcaacagggctggttggcaacatcctcattgtattcactataataagatccaggaaaaaaacagtccctgacatctatatctgcaacctggctgtggctgatttggtccacatagttggaatgccttttcttattcaccaatgggcccgagggggagagtgggtgtttggggggcctctctgcaccatcatcacatccctggatacttgtaaccaatttgcctgtagtgccatcatgactgtaatgagtgtggacaggtactttgccctcgtccaaccatttcgactgacacgttggagaacaaggtacaagaccatccggatcaatttgggcctttgggcagcttcctttatcctggcattgcctgtctgggtctactcgaaggtcatcaaatttaaagacggtgttgagagttgtgcttttgatttgacatcccctgacgatgtactctggtatacactttatttgacgataacaactttttttttccctctacccttgattttggtgtgctatattttaattttatgctatacttgggagatgtatcaacagaataaggatgccagatgctgcaatcccagtgtaccaaaacagagagtgatgaagttgacaaagatggtgctggtgctggtggtagtctttatcctgagtgctgccccttatcatgtgatacaactggtgaacttacagatggaacagcccacactggccttctatgtgggttattacctctccatctgtctcagctatgccagcagcagcattaacccttttctctacatcctgctgagtggaaatttccagaaacgtctgcctcaaatccaaagaagagcgactgagaaggaaatcaacaatatgggaaacactctgaaatcacacttttaggaaagtacatggatcaccatgagtctagacatgattgtctatcttactggtattatcagaaagggcaggtgtaccgatatgtttatgcccattcttcttgtgtacttgtgactcttagcagcatggaagagaagtgtaaccatgcaaatacaatgagcttaatatgctaactttagcaagatgtaaaa

SEQ ID NO: 152474 - DNA, 3099 bp, Homo sapiens
  Payload ID: 9987
  Gene Symbol: MC1R
  Gene Name: melanocortin 1 receptor (alpha melanocyte stimulating hormone receptor)
  Uniprot ID: Q01726
  ENST ID: ENST00000555147
  CDS Start-End: 1381-2334
agacgcagtcttcagcaaggaagtgctgggaacgccctggagtgaacccaggaagatgcctgcagtgggtgccagggcccctctccaccgtccctgctgggcttcggggccacgcccgactgctgtgaacggcctgcggagcaccacgtgcgacggctggaggcgagaggtctgcctttgatgtggctgttggtgcagggcctgtggtgccttccgcagcggaaatggcgcgccgcccggggagggcgggagcagcgtcccgggtgcccctgtgaggatgagcgacgagatgactggagggtccctgaagacctcactagggtgcccccagccggtccgctcccaggaagcgacacccccacagccccagggctgcagctgagggggtcgccactctggctgggcgaggctgggcccttgggggcaggcgccagagtggcctcaggctctacaagatgcctgaaaacaccaacctctccagggctcactagcattggacgctttcacgctctgccctggccggaagccccctcaccccgcgcgatgtgcaaactcctgcagggctcactcagtttccagaactttaattattggaaagttctccctggtccagcccccaaatctgccgtgaacgttgacagctgagttgctgctccatgcgtgctttggctgagagcagaggggacccctgtcctccctgagctgctgacgaggggaggggtgaagggtggggcctctggagagggcaggtcccggggaagctccggactcctagaggggcggccaggtgggggccctggtgaccaggacagactgtggtgttttttaacgtaaaggagatccgcggtgtgagggaccccctgggtcctgcacgccgcctggtggcaggccgggccatggtgggtgctcacgcccccggcatgtggccgccctcagtgggaggggctctgagaacgactttttaaaacgcagagaaaagctccattcttcccaggacctcagcgcagccctggcccaggaaggcaggagacagaggccaggacggtccagaggtgtcgaaatgtcctggggacctgagcagcagccaccagggaagaggcagggagggagctgaggaccaggcttggttgtgagaatccctgagcccaggcggtagatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctggtgagcgcggtgcacgcggctttaagtgtgctgggcagagggaggtggtgatattgtgtggtctggttcctgtgtgaccctgggcagttccttacctccctggtccccgtttgtcaaagaggatggactaaatgatctctgaaagtgttgaagcgcggacccttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccaatgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaatccctgcctcaggccaagggaccaggtttgcaggagcccccctagtggtatggggctgagccctcctgagggccggttctaaggctcagactgggcactggggcctcagcctgctttcctgcagcagtcgcccaagcagacagccctggcaaatgcctgactcagtgaccagtgcctgtgagcatggggccaggaaagtctggtaataaatgtgactcagcatcacccacctta

SEQ ID NO: 152475 - DNA, 3637 bp, Homo sapiens
  Payload ID: 9987
  Gene Symbol: MC1R
  Gene Name: melanocortin 1 receptor (alpha melanocyte stimulating hormone receptor)
  ENST ID: ENST00000555427
  CDS Start-End: 2304-3452
ctgcagctgagcctacttccaatgaccgtgagatctgaaagactgttttgagggcgtagcctctgccatgattgtggggaatgctgtcctgtttcctcccttggccctgctcagcccagcgagaggctgaggcgcacgtggctccccgggtgcccacaggcagcgtggctcaccagccgggcccttttccactgagccagaaccccccaaagccttcaatgcaggcaccacggtgagcccacgagaaaccctgcttgccacctcccacacccccacccccaagttcaaaggaaatggtccctgaaccaagggctgagatcagctgtgggtccagctgtcctggggagctgtactggagcccaccacggtgggactgttggtccggcggtgacccccacctccatgtctgtggccgcagctggacaggccactccctgggccacagagatgttttacctctcgcagccctcgggcacacattgagcagatgtgtgtgtgtgtgcgtgtgtgggtgggtgcgcatttgtgtgtgcctgtgtgtgtgcgcatgtggtgtgggtgcacgtgtgtgcacgtgtgtgggtaaacattgtgtgtgcgcatacgtgtgtgggtaaacatttgtatgtgcacgcgtgtgtgggtaaacgtgtgtgcgcacgtatgtatgtgtgtacatttgtatgtgtgtacatttgtatgcatgtgtgcctgtgtgtgtgtgcctgtgtgtgtgggtgcacatttgtgtgtgtgtgtgtgcctgtgtgtgtgtgtgcacgtatgtatgtgtgcacacttgtatgcatgtgtgcctgtgtgtgtgggtgcacatttgtgtgtgtgtgcctgtgtgtgtgggtgcacatttgtgtgtgtgggtgcacatttgtgtgtgtgtgcgcctgtgtgggtgcacatttgtgtgtgtgtgtgcctgtgtgtgtgcctgtgtgtgtgggtgcctgtgtgtgtggggcacatttgtgtgtgtgtgtgcctgtgtgtgggtgcacatttgtgtgtgtgcctctgtgtgtgtgcctgtgtgtgggggtgcacatttgtgtgtgcgcctgtgtgtgggggtgcacatttgtgtgtgcgcctgtgtgtgtgggtgcacatttgtgtgtgtgtgcgcctgtgtgtgtgggtgcctgtgtgtgtgtggggcacatttgtgtgtgtgtgtgtgcctgtgtgtgggtgcacatttgtgtgtgtgcctgtgtgtgtgtgcctgtgtgtgggggtgcacatttgtgtgtgtgtgtgcctgtgtgtgggggtgcacatttgtgtgtgtgtgtgcctgtgtgtgtgggtgcacatttgtgtgtgtgtgtgcctgtgtgtgtgggtgcacatttgtgtgtgtgtgcctgtgtgtgtgggtgcacatttgtgtgtgtgtgtgcctgtgtgtgtgggtgcacatttgtgtgtgtgcctgtgtgtgggtgcacatttgtgtgtgtgtgcctgtgtgtgtgtgcctgtgtgtgtgggtgcacatttgtgtgtgtgtgtgcctgtgtgtgtgggtgcacatttgtgtgtgtgtgtgtgcctgtgtgtgtgttgcaggccctggatgccagacactgaataaacgcaggaagacgtctgtcttcattctcctcgtgggtcgctggtccagaaacacctggatggaaagtgctctgcaggaacggtgcctctgcctgtggcggggaccctgcacagacgcagtcttcagcaaggaagtgctgggaacgccctggagtgaacccaggaagatgcctgcagtgggtgccagggcccctctccaccgtccctgctgggcttcggggccacgcccgactgctgtgaacggcctgcggagcaccacgtgcgacggctggaggcgagagagaaaagctccattcttcccaggacctcagcgcagccctggcccaggaaggcaggagacagaggccaggacggtccagaggtgtcgaaatgtcctggggacctgagcagcagccaccagggaagaggcagggagggagctgaggaccaggcttggttgtgagaatccctgagcccaggcggtagatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctgctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaatccctgcctcaggccaagggaccaggtttgcaggagcccccctagtggtatggggctgagccctcctgagggccggttctaaggctcagactgggcactggggcctcagcctgctttcctgcagcagtcgcccaagcagacagccctggcaaatgcctgactcagtgaccagtgcctgtgagcatggggccaggaaagtctggtaataaatgtgactcagcatcacccac

SEQ ID NO: 152476 - DNA, 3656 bp, Homo sapiens
  Payload ID: 9988
  Gene Symbol: MC2R
  Gene Name: melanocortin 2 receptor (adrenocorticotropic hormone)
  Uniprot ID: Q01718
  ENST ID: ENST00000327606
  CDS Start-End: 182-1075
gctcattccttctcattcattttgcccagaaagttcctgcttcagagctgaaggtgattgggagattttaacttagatctccagcaagtgctacaaggaagaaaagatcctgaagaatcaatcaagttttccgtgaagtcaagtccaagtaacatccccgccttaaccacaagcaggagaaatgaagcacattatcaactcgtatgaaaacatcaacaacacagcaagaaataattccgactgtcctcgtgtggttttgccggaggagatatttttcacaatttccattgttggagttttggagaatctgatcgtcctgctggctgtgttcaagaataagaatctccaggcacccatgtactttttcatctgtagcttggccatatctgatatgctgggcagcctatataagatcttggaaaatatcctgatcatattgagaaacatgggctatctcaagccacgtggcagttttgaaaccacagccgatgacatcatcgactccctgtttgtcctctccctgcttggctccatcttcagcctgtctgtgattgctgcggaccgctacatcaccatcttccacgcactgcggtaccacagcatcgtgaccatgcgccgcactgtggtggtgcttacggtcatctggacgttctgcacggggactggcatcaccatggtgatcttctcccatcatgtgcccacagtgatcaccttcacgtcgctgttcccgctgatgctggtcttcatcctgtgcctctatgtgcacatgttcctgctggctcgatcccacaccaggaagatctccaccctccccagagccaacatgaaaggggccatcacactgaccatcctgctcggggtcttcatcttctgctgggccccctttgtgcttcatgtcctcttgatgacattctgcccaagtaacccctactgcgcctgctacatgtctctcttccaggtgaacggcatgttgatcatgtgcaatgccgtcattgaccccttcatatatgccttccggagcccagagctcagggacgcattcaaaaagatgatcttctgcagcaggtactggtagaatggctgatccctggttttagaatccatgggaataacgttgccaagtgccagaatagtgtaacattccaacaaatgccagtgctcctcactggccttccttccctaatggatgcaaggatgatcccaccagctagtgtttctaatagctaggttctatgtgaacagtcttattgtaggggcaacctcttaactttgtgactggacagataaaacgatgtagtaaaagaaggatagaatacaaagtattaggtaggtacaaaagtaattaaggtttttgccattactttcaatgaccaaaaattgcaattacttttgcaccaatctagtaaaacagcaataaaaattcaagggctttgggctaaggcaaagacttgctttcctgtggacatctaacaagccagttctgaggtggcctttccaggtggaggccattgcagccaatttccagaagttaagtacctggacatgcgactccaggcagaagatgtagggtctctgtaagccaataataaattggaaggaatgcattgctgcagctgaatttgtctgtctcccacagccatgtggaatctccaccctcctctttctccctgttagtctgatgtattgatgccacctcagtttcagaaagtaggctgagtataaactataaatgtcaaataacgagcttcgagtttccaatgataaatggaccttctctgttagtcttctttgctcactcagtatcccactggccttaaaaccctttcctgttacatttcctcatgctttatgagcatacatttcaaaggaagaaatgaaaatttaatccatttagttcccatgtgggaatacataaaggccagatgaaaattgtcactatttgaagaagctgtaaccaaactatgtgtgttacaatgtagaagtacaagaaaagagccccaacatgtattttaagaaataaagagagagagacagagacagacagagagagagagagagagagagagagagagtgtgtgtgtgtgtgtgtgtgtgtgtgtgtgtgtgtgtgtgtgtgtgtgtgtattttccccatgcttttggactatggggaaaaccaaaaccaaagcaagacatcaagcaatggtgctgttattatagccccaagtcaaagacctgagggaggcaaacaccacctcattctgcagatgaatgtgaaagcagacccagtcactgggaaatgtcatcctcccatcagccaagatgccagcaatggaagagtggcaaccccagtaggaataaaagaaacataatttgcaagttcattcatttttaatagctaaaaatcagcttaaaggagaagcacatcctgattgtaagtccccactaagttggagggtgacttgaatggggtgaaaggtgaaagggacagaggagagcagtggggcttcagaggccaccaggctcaggatctgcaggatggatggtatcttccagaacaggcaatgctttgccctcaggagaatttcccagagctgctgaggggagaagacagccacacacaggacagaccatttggtgatgggtttgatattagaagtggcagggacaggaacttcagaagcaaaggaggcaaggcagctggagtcaagtgaggacagtggcaggcgtgctttcacatggcctgtcccacagatggaggtgaaaggtgcaccttcttgtcctctgttctgtagaaatccttccctgtttgatccttcccctgccaaatgaactatgttactctaatactaacctgtattaattaatatatgagatatatataagttaatttttcatgaaatctaaagcacaaccctagaactaatttttaaaagtgttatttctaccattgaaaaagtaatgtataacatattttatgtgattaaagtgcgtattctcaataagaggtaacctttttttgatgctgcaatgctctgtgataccacagaggtaagcaatgccacttaacctgtatcataaatagtcccaaactgctcttcctataaaattctgcctttgtcaacagctttgctgtctcctaatcactctcaagctctctgctgtgcatgtgactgttgtcagaaggaaaatcaccaagaaacttcacctctcactgcctttgatttgttgcagttaatctaagaaacaaaatgaagatggctagtctaatggtggatgaaacaaaaatgaagtctgagtgctaattcagagaacttgcaattccagacattttcaattctaggtcttctgctatattccaatcagaacagaagcttcagggctcatagttactgagaaaactcacgtttttctacctctaacttcatatagaattccaaatgaaagcaccaccaaactgcacatatttgtgtgaggaagatcaacaagcttcagacttttcccatgaggacttaattcttttatcaaattacccaatttttaaactgctgtgtggatactgtgagtgttcagctttatcgatgacctagccttggaccagatagctgaaaatgttcaggatgtgtactcaagctgatagtaattctgagccctgtctaataaaaaaggaaggatgt

SEQ ID NO: 152477 - DNA, 576 bp, Homo sapiens
  Payload ID: 9988
  Gene Symbol: MC2R
  Gene Name: melanocortin 2 receptor (adrenocorticotropic hormone)
  ENST ID: ENST00000399821
  CDS Start-End: 207-576
atctgcctgtgtctttccatttctctaacttcacattaccagaaatgcacagttcatgtgggatgacatttattcaaggtgattgggagattttaacttagatctccagcaagtgctacaaggaagaaaagatcctgaagaatcaatcaagttttccgtgaagtcaagtccaagtaacatccccgccttaaccacaagcaggagaaatgaagcacattatcaactcgtatgaaaacatcaacaacacagcaagaaataattccgactgtcctcgtgtggttttgccggaggagatatttttcacaatttccattgttggagttttggagaatctgatcgtcctgctggctgtgttcaagaataagaatctccaggcacccatgtactttttcatctgtagcttggccatatctgatatgctgggcagcctatataagatcttggaaaatatcctgatcatattgagaaacatgggctatctcaagccacgtggcagttttgaaaccacagccgatgacatcatcgactccctgtttgtcctctccctgcttggctccatcttcagcctgtctgtga

SEQ ID NO: 152478 - DNA, 935 bp, Homo sapiens
  Payload ID: 9989
  Gene Symbol: MRAP
  Gene Name: melanocortin 2 receptor accessory protein
  Uniprot ID: Q8TCY5
  ENST ID: ENST00000303645
  CDS Start-End: 123-641
gacccacagacacacttggacgattcctgcagaaatcagtgaggcagtctcctcccaggggcttggcgcctggctcgaggcgaggctgccggcccggacgctgactgcccagtgccacagacatggccaacgggaccaacgcctctgccccatactacagctatgaatactacctggactatctggacctcattcccgtggacgagaagaagctgaaagcccacaaacattccatcgtgatcgcattctgggtgagcctggctgccttcgtggtgctgctcttcctcatcttgctctacatgtcctggtccgcctccccgcagatgaggaacagccccaagcaccaccaaacatgcccctggagtcacggcctcaacctccacctctgcatccagaagtgcctgccgtgccacagggaacccctggcaacctcacaggctcaggcgagctcagtggagccagggagcagaactggccctgaccagccgctacgacaggagagctcctccaccttgcccctcgggggtttccagacccaccccactctcctctgggaactgaccctcaatgggggtcccctcgtcaggagcaagcccagcgagcctccccctggagacaggacctctcaattgcagagctgatgtcagtaaatcgtggccatagctgagtgaactggtgaaatcaagccaacctggacacatacgttcctcgttcttcttagaggccatttgcatgtagcagaaagggcacctaggtcaagtgcaactagagcaggagcatcctatgcctttgacaaagattgcagtggcccctcgagtgcagaggtcatcccaggtgttgctgagtttattgagcacacctagcctgcttgcttactgcttatatttgctcagggaagagtaggaaaataaaatatatgcaaatcaagaggaaaa

SEQ ID NO: 152479 - DNA, 440 bp, Homo sapiens
  Payload ID: 9989
  Gene Symbol: MRAP
  Gene Name: melanocortin 2 receptor accessory protein
  Uniprot ID: Q8TCY5
  ENST ID: ENST00000339944
  CDS Start-End: 1-309
atggccaacgggaccaacgcctctgccccatactacagctatgaatactacctggactatctggacctcattcccgtggacgagaagaagctgaaagcccacaaacattccatcgtgatcgcattctgggtgagcctggctgccttcgtggtgctgctcttcctcatcttgctctacatgtcctggtccgcctccccgcagatgagctttaacacagatgaatctcttctgcattcagaagtgctgcctcaaactcgagctatttcctgtgatgagctccaagcccctagagaggaaggggcggcctgacgaggcactggatgggcctcatggcctagaagtccccacattccttgcaactctgatgctgggcacctacaggcccgagtttatcatttactgggcagttcaataaagtcctctcaacttttcttgtcaaa

SEQ ID NO: 152480 - DNA, 1000 bp, Homo sapiens
  Payload ID: 9989
  Gene Symbol: MRAP
  Gene Name: melanocortin 2 receptor accessory protein
  Uniprot ID: Q8TCY5
  ENST ID: ENST00000399784
  CDS Start-End: 188-706
ggataatggggaggctatgcaggtgtgtgggctggagggactttgcagatgtgattaaggattgtgagatggaaaaattatccttgattacctgcacggacccagtataatcacaactgtccttataagaagaggagctttggaagaagagagagttgactacggaagagggaaaagtgccacagacatggccaacgggaccaacgcctctgccccatactacagctatgaatactacctggactatctggacctcattcccgtggacgagaagaagctgaaagcccacaaacattccatcgtgatcgcattctgggtgagcctggctgccttcgtggtgctgctcttcctcatcttgctctacatgtcctggtccgcctccccgcagatgaggaacagccccaagcaccaccaaacatgcccctggagtcacggcctcaacctccacctctgcatccagaagtgcctgccgtgccacagggaacccctggcaacctcacaggctcaggcgagctcagtggagccagggagcagaactggccctgaccagccgctacgacaggagagctcctccaccttgcccctcgggggtttccagacccaccccactctcctctgggaactgaccctcaatgggggtcccctcgtcaggagcaagcccagcgagcctccccctggagacaggacctctcaattgcagagctgatgtcagtaaatcgtggccatagctgagtgaactggtgaaatcaagccaacctggacacatacgttcctcgttcttcttagaggccatttgcatgtagcagaaagggcacctaggtcaagtgcaactagagcaggagcatcctatgcctttgacaaagattgcagtggcccctcgagtgcagaggtcatcccaggtgttgctgagtttattgagcacacctagcctgcttgcttactgcttatatttgctcagggaagagtaggaaaataaaatatatgcaaatcaagaggaaaa

SEQ ID NO: 152481 - DNA, 2153 bp, Homo sapiens
  Payload ID: 9990
  Gene Symbol: MRAP2
  Gene Name: melanocortin 2 receptor accessory protein 2
  Uniprot ID: Q96G30
  ENST ID: ENST00000257776
  CDS Start-End: 136-753
ctcggatctaggagctactcgcccggccctgggcggtgggaggcggcggcggcggcggcgctcgcgcacctcggaggagccaggagccggaaccagggccgagcccgcgggccggggctagccagccggtcggagatgtccgcccagaggttaatttctaacagaacctcccagcaatcggcatctaattctgattacacctgggaatatgaatattatgagattggaccagtttcctttgaaggactgaaggctcataaatattccattgtgattggattttgggttggtcttgcagtcttcgtgatttttatgttttttgtgctgaccttgctgaccaagacaggagccccacaccaagacaatgcagagtcctcagagaagagattcagaatgaacagctttgtgtcagactttggaagacctctggagccagataaagtattttctcgccaaggcaacgaggagtccaggtctctctttcactgctacatcaatgaggtggaacgcttggacagagccaaagcttgtcaccagaccacagcccttgacagtgacgtccaactccaggaagccatcagaagcagtgggcagccagaggaggagctgaacaggctcatgaagtttgacatccccaactttgtgaacacagaccagaactactttggggaggatgatcttctgatttctgaaccacctattgttctggaaactaagccactttcccagacctcacacaaagacctggattgagaaacatgctctgtaaagggtcttcctgaagatgtggattctatctttatgtagcaagaaatctacatccaccaaaattgtgtgtgtttgggggagagagagacatagagatagagacagagaggcagagaagagacccctttagaagagagctgagctgattaagctgagtggttttttgttttgttttgtttttgctttttaatacatttggagctttgggagtattaaagtatttacaccaagcttgtccaacccgtggcatgtgtcccaggacagctttgaatgtggcccaatacaaattttaaactttattaaaacatgagttttgtttttttttttgctattttttttaaagctcgtcagctatcgttagtgttagtgtactttatgtgtggcccaagacaactcttcttccagtgtggcacagggaagctaaaagattggacacctctgatttatactagctcgttttgcttgttgaaaaatttggccaaatacctattgtcagcattcttgggtgaggattagcctaccatgttctaatctggccctgccactactatgctctacctttggtgagttgctttacctctctgggctgccccatttttaactgtaggttgacaggtctagagtgatccatcccacctctaatattttgtgaatttatgactttgccttcagatgaggctgagctatacataaaacagtataaactagggtactgcctcgtatctcttgtaggctctctcaaatctctgtaccttccacttaaccctaattgagccaagctttagtcaggggatctggttgtctaccagaatgtcaggagactcatcttacacagtcatggtggccaatgtttctggtgggttgtgctgaaacagctcttctgagaacttccaaccacccatgctctaacctggagacagccatcccctgcctcagaataagtaccaattcgtagtacatgtatggtactcttgtccccaagaaatgttaggaagcttgtcagctgaatgagaggaggtgccttctgggtatctctgtgttggtgtatctgtgccattggctacagaacaagaaaaatactatttgccatgctattaccttggcagatgtgtaggtgatagtcatctggctttgagctgagatggtcagtgggttgtaaattccccactagcagatattcagggtggcctgagttatgtaaacaagtgagcaacacagctttaatttcatggaggaatcaaagctgcacactggtattaaaacaacttgattttgcgcacacagttgcatgcatggcaagctgttaacctctgggtggcattttcattatgaatttgttcaccacctgtcttgcttaagctacaaaataaatgcatttgactgca

SEQ ID NO: 152482 - DNA, 1084 bp, Homo sapiens
  Payload ID: 9991
  Gene Symbol: MC3R
  Gene Name: melanocortin 3 receptor
  Uniprot ID: P41968
  ENST ID: ENST00000243911
  CDS Start-End: 113-1084
aatgagcatccaaaagacgtatctggagggagattttgtctttcctgtgagcagcagcagcttcctacggaccctgctggagccccagctcggatcagcccttctgacagcaatgaatgcttcgtgctgcctgccctctgttcagccaacactgcctaatggctcggagcacctccaagcccctttcttcagcaaccagagcagcagcgccttctgtgagcaggtcttcatcaagcccgaggttttcctgtctctgggcatcgtcagtctgctggaaaacatcctggttatcctggccgtggtcaggaacggcaacctgcactccccgatgtacttctttctctgcagcctggcggtggccgacatgctggtaagtgtgtccaatgccctggagaccatcatgatcgccatcgtccacagcgactacctgaccttcgaggaccagtttatccagcacatggacaacatcttcgactccatgatctgcatctccctggtggcctccatctgcaacctcctggccatcgccgtcgacaggtacgtcaccatcttttacgcgctccgctaccacagcatcatgaccgtgaggaaggccctcaccttgatcgtggccatctgggtctgctgcggcgtctgtggcgtggtgttcatcgtctactcggagagcaaaatggtcattgtgtgcctcatcaccatgttcttcgccatgatgctcctcatgggcaccctctacgtgcacatgttcctctttgcgcggctgcacgtcaagcgcatagcagcactgccacctgccgacggggtggccccacagcaacactcatgcatgaagggggcagtcaccatcaccattctcctgggcgtgttcatcttctgctgggcccccttcttcctccacctggtcctcatcatcacctgccccaccaacccctactgcatctgctacactgcccacttcaacacctacctggtcctcatcatgtgcaactccgtcatcgacccactcatctacgctttccggagcctggaattgcgcaacacctttagggagattctctgtggctgcaacggcatgaacttgggatag

SEQ ID NO: 152483 - DNA, 1666 bp, Homo sapiens
  Payload ID: 9992
  Gene Symbol: MC4R
  Gene Name: melanocortin 4 receptor
  Uniprot ID: P32245
  ENST ID: ENST00000299766
  CDS Start-End: 427-1425
aacactcaaagcaacgctcaggctggaaacagaagcttccgagaggcagccgatgtgagcatgtgcgcacagattcgtctcccaatggcatggcagcttcaaggaaaattattttgaacagacttgaatgcataagattaaagttaaagcagaagtgagaacaagaaagcaaagagcagactctttcaactgagaatgaatattttgaagcccaagattttaaagtgatgatgattagagtcgtacctaaaagagactaaaaactccatgtcaagctctggacttgtgacatttactcacagcaggcatggcaattttagcctcacaactttcagacagataaagacttggaggaaataactgagacgactccctgacccaggaggttaaatcaattcagggggacactggaattctcctgccagcatggtgaactccacccaccgtgggatgcacacttctctgcacctctggaaccgcagcagttacagactgcacagcaatgccagtgagtcccttggaaaaggctactctgatggagggtgctacgagcaactttttgtctctcctgaggtgtttgtgactctgggtgtcatcagcttgttggagaatatcttagtgattgtggcaatagccaagaacaagaatctgcattcacccatgtactttttcatctgcagcttggctgtggctgatatgctggtgagcgtttcaaatggatcagaaaccattgtcatcaccctattaaacagtacagatacggatgcacagagtttcacagtgaatattgataatgtcattgactcggtgatctgtagctccttgcttgcatccatttgcagcctgctttcaattgcagtggacaggtactttactatcttctatgctctccagtaccataacattatgacagttaagcgggttgggatcatcataagttgtatctgggcagcttgcacggtttcaggcattttgttcatcatttactcagatagtagtgctgtcatcatctgcctcatcaccatgttcttcaccatgctggctctcatggcttctctctatgtccacatgttcctgatggccaggcttcacattaagaggattgctgtcctccccggcactggtgccatccgccaaggtgccaatatgaagggagcgattaccttgaccatcctgattggcgtctttgttgtctgctgggccccattcttcctccacttaatattctacatctcttgtcctcagaatccatattgtgtgtgcttcatgtctcactttaacttgtatctcatactgatcatgtgtaattcaatcatcgatcctctgatttatgcactccggagtcaagaactgaggaaaaccttcaaagagatcatctgttgctatcccctgggaggcctttgtgacttgtctagcagatattaaatggggacagagcacgcaatataggaacatgcataagagactttttcactcttaccctacctgaatattgtacttctgcaacagctttctcttccgtgtagggtactggttgagaatatccattgtgtaaatttaagcctatgatttttaatgagaaaaaatgcccagtctctgtattatttccaatgtcatgctacttttttggccataaaatatgaatctatgttataggttgtaggca

SEQ ID NO: 152484 - DNA, 1200 bp, Homo sapiens
  Payload ID: 9993
  Gene Symbol: MC5R
  Gene Name: melanocortin 5 receptor
  Uniprot ID: P33032
  ENST ID: ENST00000324750
  CDS Start-End: 223-1200
catagggagaccctgtctcttaaaaaaaaaaaaaaaaaaggactgagtgagccgagcccagtcctctgatgcactgtgtcattcatcccctttcttaggctgtgttggttctaggctagctgctgtctttctttggtaggctgctaacctctttggattgtgaatttaaaacatgttttacagtaaatttgctgccaagacaagaggtgtatttctccagcaatgaattcctcatttcacctgcatttcttggatctcaacctgaatgccacagagggcaacctttcaggacccaatgtcaaaaacaagtcttcaccatgtgaagacatgggcattgctgtggaggtgtttctcactctgggtgtcatcagcctcttggagaacatcttggtcataggggccatagtgaagaacaaaaacctgcactcccccatgtacttcttcgtgtgcagcctggcagtggcggacatgctggtgagcatgtccagtgcctgggagaccatcaccatctacctactcaacaacaagcacctagtgatagcagacgcctttgtgcgccacattgacaatgtgtttgactccatgatctgcatttccgtggtggcatccatgtgcagcttactggccattgcagtggataggtacgtcaccatcttctacgccctgcgctaccaccacatcatgacggcgaggcgctcaggggccatcatcgccggcatctgggctttctgcacgggctgcggcattgtcttcatcctgtactcagaatccacctacgtcatcctgtgcctcatctccatgttcttcgctatgctgttcctcctggtgtctctgtacatacacatgttcctcctggcgcggactcacgtcaagcggatcgcggctctgcccggggccagctctgcgcggcagaggaccagcatgcagggcgcggtcaccgtcaccatgctgctgggcgtgtttaccgtgtgctgggccccgttcttccttcatctcactttaatgctttcttgccctcagaacctctactgctctcgcttcatgtctcacttcaatatgtacctcatactcatcatgtgtaattccgtgatggaccctctcatatatgccttccgcagccaagagatgcggaagacctttaaggagattatttgctgccgtggtttcaggatcgcctgcagctttcccagaagggattaa

SEQ ID NO: 152485 - DNA, 678 bp, Homo sapiens
  Payload ID: 9993
  Gene Symbol: MC5R
  Gene Name: melanocortin 5 receptor
  ENST ID: ENST00000589410
  CDS Start-End: 160-678
gcagccgcctagctgggggagaggcccgtccggggctggctctgagcgccgcacggccgtcggatcccggggacgccgggggcccgggctgagcgccgcggcccgcgaggaggagcaccgtaaatttgctgccaagacaagaggtgtatttctccagcaatgaattcctcatttcacctgcatttcttggatctcaacctgaatgccacagagggcaacctttcaggacccaatgtcaaaaacaagtcttcaccatgtgaagacatgggcattgctgtggaggtgtttctcactctgggtgtcatcagcctcttggagaacatcttggtcataggggccatagtgaagaacaaaaacctgcactcccccatgtacttcttcgtgtgcagcctggcagtggcggacatgctggtgagcatgtccagtgcctgggagaccatcaccatctacctactcaacaacaagcacctagtgatagcagacgcctttgtgcgccacattgacaatgtgtttgactccatgatctgcatttccgtggtggcatccatgtgcagcttactggccattgcagtggataggtacgtcaccatcttctacgccctgcgctaccaccacatcatgacggcgaggcgctcaggggccatcatcgccggcatctgggctttctgcacgggctgc

SEQ ID NO: 152486 - DNA, 1710 bp, Homo sapiens
  Payload ID: 9994
  Gene Symbol: MAGEA1
  Gene Name: melanoma antigen family A1
  Uniprot ID: P43355
  ENST ID: ENST00000356661
  CDS Start-End: 220-1149
gagagaagcgaggtttccattctgagggacggcgtagagttcggccgaaggaacctgacccaggctctgtgaggaggcaaggttttcaggggacaggccaacccagaggacaggattccctggaggccacagaggagcaccaaggagaagatctgcctgtgggtcttcattgcccagctcctgcccacactcctgcctgctgccctgacgagagtcatcatgtctcttgagcagaggagtctgcactgcaagcctgaggaagcccttgaggcccaacaagaggccctgggcctggtgtgtgtgcaggctgccacctcctcctcctctcctctggtcctgggcaccctggaggaggtgcccactgctgggtcaacagatcctccccagagtcctcagggagcctccgcctttcccactaccatcaacttcactcgacagaggcaacccagtgagggttccagcagccgtgaagaggaggggccaagcacctcttgtatcctggagtccttgttccgagcagtaatcactaagaaggtggctgatttggttggttttctgctcctcaaatatcgagccagggagccagtcacaaaggcagaaatgctggagagtgtcatcaaaaattacaagcactgttttcctgagatcttcggcaaagcctctgagtccttgcagctggtctttggcattgacgtgaaggaagcagaccccaccggccactcctatgtccttgtcacctgcctaggtctctcctatgatggcctgctgggtgataatcagatcatgcccaagacaggcttcctgataattgtcctggtcatgattgcaatggagggcggccatgctcctgaggaggaaatctgggaggagctgagtgtgatggaggtgtatgatgggagggagcacagtgcctatggggagcccaggaagctgctcacccaagatttggtgcaggaaaagtacctggagtaccggcaggtgccggacagtgatcccgcacgctatgagttcctgtggggtccaagggccctcgctgaaaccagctatgtgaaagtccttgagtatgtgatcaaggtcagtgcaagagttcgctttttcttcccatccctgcgtgaagcagctttgagagaggaggaagagggagtctgagcatgagttgcagccaaggccagtgggagggggactgggccagtgcaccttccagggccgcgtccagcagcttcccctgcctcgtgtgacatgaggcccattcttcactctgaagagagcggtcagtgttctcagtagtaggtttctgttctattgggtgacttggagatttatctttgttctcttttggaattgttcaaatgtttttttttaagggatggttgaatgaacttcagcatccaagtttatgaatgacagcagtcacacagttctgtgtatatagtttaagggtaagagtcttgtgttttattcagattgggaaatccattctattttgtgaattgggataataacagcagtggaataagtacttagaaatgtgaaaaatgagcagtaaaatagatgagataaagaactaaagaaattaagagatagtcaattcttgccttatacctcagtctattctgtaaaatttttaaagatatatgcatacctggatttccttggcttctttgagaatgtaagagaaattaaatctgaataaagaattcttcctgttca

SEQ ID NO: 152487 - DNA, 2741 bp, Homo sapiens
  Payload ID: 9995
  Gene Symbol: MAGEA10
  Gene Name: melanoma antigen family A10
  Uniprot ID: P43363
  ENST ID: ENST00000244096
  CDS Start-End: 434-1543
actaacttacgcctcggggatcagagagaagcgaggttctcgttctgagggacaggcttgagatcggctgaagagagcgggcccaggctctgtgaggaggcaagggaggtgagaaccttgctctcagagggtgactcaagtcaacacagggaacccctcttttctacagacacagtgggtcgcaggatctgacaagagtccaggagctccagggactgtgaggtgaggccttggtctaaggcagtgttttcaggtcacagagcagaaagggcccagacagtgccaggagtcaaggttctcaggggacagggagagcaagaggtcaagagctgtgggacaccacagagcagcactgaaggagaagacctgcctgtgggtccccatcgcccaagtcctgcccacactcccacctgctaccctgatcagagtcatcatgcctcgagctccaaagcgtcagcgctgcatgcctgaagaagatcttcaatcccaaagtgagacacagggcctcgagggtgcacaggctcccctggctgtggaggaggatgcttcatcatccacttccaccagctcctcttttccatcctcttttccctcctcctcctcttcctcctcctcctcctgctatcctctaataccaagcaccccagaggaggtttctgctgatgatgagacaccaaatcctccccagagtgctcagatagcctgctcctccccctcggtcgttgcttcccttccattagatcaatctgatgagggctccagcagccaaaaggaggagagtccaagcaccctacaggtcctgccagacagtgagtctttacccagaagtgagatagatgaaaaggtgactgatttggtgcagtttctgctcttcaagtatcaaatgaaggagccgatcacaaaggcagaaatactggagagtgtcataagaaattatgaagaccacttccctttgttgtttagtgaagcctccgagtgcatgctgctggtctttggcattgatgtaaaggaagtggatcccactggccactcctttgtccttgtcacctccctgggcctcacctatgatgggatgctgagtgatgtccagagcatgcccaagactggcattctcatacttatcctaagcatagtcttcatagagggctactgcacccctgaggaggtcatctgggaagcactgaatatgatggggctgtatgatgggatggagcacctcatttatggggagcccaggaagctgctcacccaagattgggtgcaggaaaactacctggagtaccggcaggtgcctggcagtgatcctgcacggtatgagtttctgtggggtccaagggctcatgctgaaattaggaagatgagtctcctgaaatttttggccaaggtaaatgggagtgatccaagatccttcccactgtggtatgaggaggctttgaaagatgaggaagagagagcccaggacagaattgccaccacagatgatactactgccatggccagtgcaagttctagcgctacaggtagcttctcctaccctgaataaagtaagacagattcttcactgtgttttaaaaggcaagtcaaataccacatgattttactcatatgtggaatctaaaaaaaaaaaaaaaaaaagttggtatcatggaagtagagagtagagcagtagttacattacaattaaataggaggaataagttctagtgttctattgcacagtaggatgactatagttaacattaagatattgtatattacaaaacagctagaaggaaggcttttcaatattgtcaccaaaaagaaatgataaatgcatgaggtgatggatacactacctgatttgatcattatactacatatacatgaatcagaacatcaaattgtacctcataaatatctacaattacatgtcagtttttgtttatgtttttgtttttttttaatttatgaaaacaaatgagaatggaaatcaatgatgtatgtggtggagggccaggctgaggctgaggaaaatacagtgcataacatctttgtcttactgttttctttggataacctggggacttcttttcttttcttcttggtattttattttctttttcttcttcttctttttttttttttaacaaagtctcactctattgctctggcaggagtgcagtggtgcagtctcggctcactgcaacttccgcctcctgggttcaagcgattctcctgcctcagtctcctgagtagctgggattacaagtgtgcaccaccatacccggctaattttgtattttttagtagagatggggtttcaccatgttggccaggctggtctcaaactcctgacctcaggtaatctgcccgcctcagcctcccaaagtgctgggataacaggtgtgagccactgcacccagcctcttcttggtattttaaaatgttgttacttttactagaatgtttatgagcttcagaatctaaggtcacacgttcgtttctgtttatccagtttaagaaacagttttgctattttgtaaaacaaattgggaacccttccatcatatttgtaatctgtaataaaataacatggaattggaatagtaattttcttggaaatatgaaaaaaatagtaaaatagagaaaataattttaagtgttagtatttttatttctttattatttttagtttatcatcctgcaaaattaaaagttatatccctggatcttgttaagtcgaaattaaactgtaataaatg

SEQ ID NO: 152488 - DNA, 2628 bp, Homo sapiens
  Payload ID: 9995
  Gene Symbol: MAGEA10
  Gene Name: melanoma antigen family A10
  Uniprot ID: P43363
  ENST ID: ENST00000370323
  CDS Start-End: 318-1427
gagaagcgaggttctcgttctgagggacaggcttgagatcggctgaagagagcgggcccaggctctgtgaggaggcaagggaggtgagaaccttgctctcagagggtgactcaagtcaacacagggaacccctcttttctacagacacagtgggtcgcaggatctgacaagagtccaggttctcaggggacagggagagcaagaggtcaagagctgtgggacaccacagagcagcactgaaggagaagacctgcctgtgggtccccatcgcccaagtcctgcccacactcccacctgctaccctgatcagagtcatcatgcctcgagctccaaagcgtcagcgctgcatgcctgaagaagatcttcaatcccaaagtgagacacagggcctcgagggtgcacaggctcccctggctgtggaggaggatgcttcatcatccacttccaccagctcctcttttccatcctcttttccctcctcctcctcttcctcctcctcctcctgctatcctctaataccaagcaccccagaggaggtttctgctgatgatgagacaccaaatcctccccagagtgctcagatagcctgctcctccccctcggtcgttgcttcccttccattagatcaatctgatgagggctccagcagccaaaaggaggagagtccaagcaccctacaggtcctgccagacagtgagtctttacccagaagtgagatagatgaaaaggtgactgatttggtgcagtttctgctcttcaagtatcaaatgaaggagccgatcacaaaggcagaaatactggagagtgtcataagaaattatgaagaccacttccctttgttgtttagtgaagcctccgagtgcatgctgctggtctttggcattgatgtaaaggaagtggatcccactggccactcctttgtccttgtcacctccctgggcctcacctatgatgggatgctgagtgatgtccagagcatgcccaagactggcattctcatacttatcctaagcatagtcttcatagagggctactgcacccctgaggaggtcatctgggaagcactgaatatgatggggctgtatgatgggatggagcacctcatttatggggagcccaggaagctgctcacccaagattgggtgcaggaaaactacctggagtaccggcaggtgcctggcagtgatcctgcacggtatgagtttctgtggggtccaagggctcatgctgaaattaggaagatgagtctcctgaaatttttggccaaggtaaatgggagtgatccaagatccttcccactgtggtatgaggaggctttgaaagatgaggaagagagagcccaggacagaattgccaccacagatgatactactgccatggccagtgcaagttctagcgctacaggtagcttctcctaccctgaataaagtaagacagattcttcactgtgttttaaaaggcaagtcaaataccacatgattttactcatatgtggaatctaaaaaaaaaaaaaaaaaaagttggtatcatggaagtagagagtagagcagtagttacattacaattaaataggaggaataagttctagtgttctattgcacagtaggatgactatagttaacattaagatattgtatattacaaaacagctagaaggaaggcttttcaatattgtcaccaaaaagaaatgataaatgcatgaggtgatggatacactacctgatttgatcattatactacatatacatgaatcagaacatcaaattgtacctcataaatatctacaattacatgtcagtttttgtttatgtttttgtttttttttaatttatgaaaacaaatgagaatggaaatcaatgatgtatgtggtggagggccaggctgaggctgaggaaaatacagtgcataacatctttgtcttactgttttctttggataacctggggacttcttttcttttcttcttggtattttattttctttttcttcttcttctttttttttttttaacaaagtctcactctattgctctggcaggagtgcagtggtgcagtctcggctcactgcaacttccgcctcctgggttcaagcgattctcctgcctcagtctcctgagtagctgggattacaagtgtgcaccaccatacccggctaattttgtattttttagtagagatggggtttcaccatgttggccaggctggtctcaaactcctgacctcaggtaatctgcccgcctcagcctcccaaagtgctgggataacaggtgtgagccactgcacccagcctcttcttggtattttaaaatgttgttacttttactagaatgtttatgagcttcagaatctaaggtcacacgttcgtttctgtttatccagtttaagaaacagttttgctattttgtaaaacaaattgggaacccttccatcatatttgtaatctgtaataaaataacatggaattggaatagtaattttcttggaaatatgaaaaaaatagtaaaatagagaaaataattttaagtgttagtatttttatttctttattatttttagtttatcatcctgcaaaattaaaagttatatccctggatcttgttaagtcgaaattaaactgtaataaatgaaa

SEQ ID NO: 152489 - DNA, 901 bp, Homo sapiens
  Payload ID: 9995
  Gene Symbol: MAGEA10
  Gene Name: melanoma antigen family A10
  ENST ID: ENST00000427322
  CDS Start-End: 417-901
ggatcagagagaagcgaggttctcgttctgagggacaggcttgagatcggctgaagagagcgggcccaggctctgtgaggaggcaagggaggtgagaaccttgctctcagagggtgactcaagtcaacacagggaacccctcttttctacagacacagtgggtcgcaggatctgacaagagtccaggagctccagggactgtgaggtgaggccttggtctaaggcagtgttttcaggtcacagagcagaaagggcccagacagtgccaggagtcaaggttctcaggggacagggagagcaagaggtcaagagctgtgggacaccacagagcagcactgaaggagaagacctgcctgtgggtccccatcgcccaagtcctgcccacactcccacctgctaccctgatcagagtcatcatgcctcgagctccaaagcgtcagcgctgcatgcctgaagaagatcttcaatcccaaagtgagacacagggcctcgagggtgcacaggctcccctggctgtggaggaggatgcttcatcatccacttccaccagctcctcttttccatcctcttttccctcctcctcctcttcctcctcctcctcctgctatcctctaataccaagcaccccagaggaggtttctgctgatgatgagacaccaaatcctccccagagtgctcagatagcctgctcctccccctcggtcgttgcttcccttccattagatcaatctgatgagggctccagcagccaaaaggaggagagtccaagcaccctacaggtcctgccagacagtgagtctttacccagaagtgagatagatgaaaaggtgactgatttggtgcagtttctgctcttcaagtatcaaatgaaggagccgatcacaaaggcagaaatactgga

SEQ ID NO: 152490 - DNA, 781 bp, Homo sapiens
  Payload ID: 9995
  Gene Symbol: MAGEA10
  Gene Name: melanoma antigen family A10
  ENST ID: ENST00000444834
  CDS Start-End: 229-781
tgaagagagcgggcccaggctctgtgaggaggcaagacacagtgggtcgcaggatctgacaagagtccaggagctccagggactgtgaggttctcaggggacagggagagcaagaggtcaagagctgtgggacaccacagagcagcactgaaggagaagacctgcctgtgggtccccatcgcccaagtcctgcccacactcccacctgctaccctgatcagagtcatcatgcctcgagctccaaagcgtcagcgctgcatgcctgaagaagatcttcaatcccaaagtgagacacagggcctcgagggtgcacaggctcccctggctgtggaggaggatgcttcatcatccacttccaccagctcctcttttccatcctcttttccctcctcctcctcttcctcctcctcctcctgctatcctctaataccaagcaccccagaggaggtttctgctgatgatgagacaccaaatcctccccagagtgctcagatagcctgctcctccccctcggtcgttgcttcccttccattagatcaatctgatgagggctccagcagccaaaaggaggagagtccaagcaccctacaggtcctgccagacagtgagtctttacccagaagtgagatagatgaaaaggtgactgatttggtgcagtttctgctcttcaagtatcaaatgaaggagccgatcacaaaggcagaaatactggagagtgtcataagaaattatgaagaccacttccctttgttgtttagtgaagcctccgagtgcatgctgc

SEQ ID NO: 152491 - DNA, 713 bp, Homo sapiens
  Payload ID: 9995
  Gene Symbol: MAGEA10
  Gene Name: melanoma antigen family A10
  ENST ID: ENST00000579960
  CDS Start-End: 539-713
gacaggcttgagatcggctgaagagagcgggcccaggctctgtgaggaggcaagggaggtgagaaccttgctctcagagggtgactcaagtcaacacagggaacccctcttttctacagacacagtgggtcgcaggatctgacaagagtccaggagctccagggactgtgaggtgaggccttggtctaaggcagtgttttcaggtcacagagcagaaagggcccagacagtgccaggagtcaaggtgaggtgcatgccctgaatgtgtaccaagggccccacctgctccaggacaaagtggaccccactgcatcagctccacctaccctactgtcagtcctggagccttggcctctgccggctgcatcctgaggagccatctctcacttccttcttcaggttctcaggggacagggagagcaagaggtcaagagctgtgggacaccacagagcagcactgaaggagaagacctgcctgtgggtccccatcgcccaagtcctgcccacactcccacctgctaccctgatcagagtcatcatgcctcgagctccaaagcgtcagcgctgcatgcctgaagaagatcttcaatcccaaagtgagacacagggcctcgagggtgcacaggctcccctggctgtggaggaggatgcttcatcatccacttccaccagctcctcttttccatcctcttttccctcctcctcctcttcct

SEQ ID NO: 152492 - DNA, 536 bp, Homo sapiens
  Payload ID: 9995
  Gene Symbol: MAGEA10
  Gene Name: melanoma antigen family A10
  ENST ID: ENST00000583480
  CDS Start-End: 324-536
ctcgttctgagggacaggcttgagatcggctgaagagagcgggcccaggctctgtgaggaggcaagggaggtgagaaccttgctctcagagggtgactcaagtcaacacagggaacccctcttttctacagacacagtgggtcgcaggatctgacaagagtccaggagctccagggactgtgaggttctcaggggacagggagagcaagaggtcaagagctgtgggacaccacagagcagcactgaaggagaagacctgcctgtgggtccccatcgcccaagtcctgcccacactcccacctgctaccctgatcagagtcatcatgcctcgagctccaaagcgtcagcgctgcatgcctgaagaagatcttcaatcccaaagtgagacacagggcctcgagggtgcacaggctcccctggctgtggaggaggatgcttcatcatccacttccaccagctcctcttttccatcctcttttccctcctcctcctcttcctcctcctcctcctgctatcctctaataccaagcacccca

SEQ ID NO: 152493 - DNA, 1845 bp, Homo sapiens
  Payload ID: 9996
  Gene Symbol: MAGEA11
  Gene Name: melanoma antigen family A11
  ENST ID: ENST00000333104
  CDS Start-End: 153-1355
tgcactctcaccagggcagggagctgtcttgacccccagtggaggctgacaatttttttcctgtgtacactggacccctttcatagaggtgggtgctatgcaagtggagctggtgactgatggctgaccattgatacaggctaggaataccaatgagcaaggtgagcactatgttctcagaggacgacttccagtcaacagaaagagccccatatggtccacaactacagtggtcccaggatctgccaagagtccaggtttttagagaacaggccaacctggaggacaggagtcccaggagaacccagaggatcactggaggagaacaagtgctgtggggccccatcacccagatatttcccacagttcggcctgctgacctaaccagagtcatcatgcctcttgagcaaagaagtcagcactgcaagcctgaggaaggccttcaggcccaagaagaagacctgggcctggtgggtgcacaggctctccaagctgaggagcaggaggctgccttcttctcctctactctgaatgtgggcactctagaggagttgcctgctgctgagtcaccaagtcctccccagagtcctcaggaagagtccttctctcccactgccatggatgccatctttgggagcctatctgatgagggctctggcagccaagaaaaggaggggccaagtacctcgcctgacctgatagaccctgagtccttttcccaagatatactacatgacaagataattgatttggttcatttattgctccgcaagtatcgagtcaaggggctgatcacaaaggcagaaatgctggggagtgtcatcaaaaattatgaggactactttcctgagatatttagggaagcctctgtatgcatgcaactgctctttggcattgatgtgaaggaagtggaccccactagccactcctatgtccttgtcacctccctcaacctctcttatgatggcatacagtgtaatgagcagagcatgcccaagtctggcctcctgataatagtcctgggtgtaatcttcatggaggggaactgcatccctgaagaggttatgtgggaagtcctgagcattatgggggtgtatgctggaagggagcacttcctctttggggagcccaagaggctccttacccaaaattgggtgcaggaaaagtacctggtgtaccggcaggtgcccggcactgatcctgcatgctatgagttcctgtggggtccaagggcccacgctgagaccagcaagatgaaagttcttgagtacatagccaatgccaatgggagggatcccacttcttacccatccctgtatgaagatgctttgagagaggagggagagggagtctgagcatgagatgcaaccagggccagcgggcagggaaatgggccaatgcatgcttcagggccacacccagcagtttccctgtcctgtgtgaaatcaggcccattcttccctctgtgtttgatgagagaagtcagtgttctcagtagtagaaggcacagtgaatggaagggaacacattgtatactgcctttaggtttctcttccatcgggtgacttggagatttctttttgtttccctttggtaattttcaaatattgttcctgtaataaaagttttagttagcttcaacatctaagtgtatggatgatactgaccacacatgttgttttgcttatccatttcaagtgcaagtgtttgccattttgtaaaacattttgggaaatcttccatcttgctgtgatttgcaataggtattttcttggagaatgtaagaacttaacaataaagctgaactggtgttgtgaaacagagaaataaaaggagaaggtcatt

SEQ ID NO: 152494 - DNA, 1864 bp, Homo sapiens
  Payload ID: 9996
  Gene Symbol: MAGEA11
  Gene Name: melanoma antigen family A11
  Uniprot ID: P43364
  ENST ID: ENST00000355220
  CDS Start-End: 103-1392
gatctgagagaagcgaaagcgtctttctgaggggtgtcttgagagtggcagagggcagcgggtccaggctccatgaggaggcaagccttgggaatctgagggatggagactcagttccgcagagggggtctggggtgcagccctgccagcatcaagaggaagaagaagagggaggactcaggagactttggactccaggtgagcactatgttctcagaggacgacttccagtcaacagaaagagccccatatggtccacaactacagtggtcccaggatctgccaagagtccaggtttttagagaacaggccaacctggaggacaggagtcccaggagaacccagaggatcactggaggagaacaagtgctgtggggccccatcacccagatatttcccacagttcggcctgctgacctaaccagagtcatcatgcctcttgagcaaagaagtcagcactgcaagcctgaggaaggccttcaggcccaagaagaagacctgggcctggtgggtgcacaggctctccaagctgaggagcaggaggctgccttcttctcctctactctgaatgtgggcactctagaggagttgcctgctgctgagtcaccaagtcctccccagagtcctcaggaagagtccttctctcccactgccatggatgccatctttgggagcctatctgatgagggctctggcagccaagaaaaggaggggccaagtacctcgcctgacctgatagaccctgagtccttttcccaagatatactacatgacaagataattgatttggttcatttattgctccgcaagtatcgagtcaaggggctgatcacaaaggcagaaatgctggggagtgtcatcaaaaattatgaggactactttcctgagatatttagggaagcctctgtatgcatgcaactgctctttggcattgatgtgaaggaagtggaccccactagccactcctatgtccttgtcacctccctcaacctctcttatgatggcatacagtgtaatgagcagagcatgcccaagtctggcctcctgataatagtcctgggtgtaatcttcatggaggggaactgcatccctgaagaggttatgtgggaagtcctgagcattatgggggtgtatgctggaagggagcacttcctctttggggagcccaagaggctccttacccaaaattgggtgcaggaaaagtacctggtgtaccggcaggtgcccggcactgatcctgcatgctatgagttcctgtggggtccaagggcccacgctgagaccagcaagatgaaagttcttgagtacatagccaatgccaatgggagggatcccacttcttacccatccctgtatgaagatgctttgagagaggagggagagggagtctgagcatgagatgcaaccagggccagcgggcagggaaatgggccaatgcatgcttcagggccacacccagcagtttccctgtcctgtgtgaaatcaggcccattcttccctctgtgtttgatgagagaagtcagtgttctcagtagtagaaggcacagtgaatggaagggaacacattgtatactgcctttaggtttctcttccatcgggtgacttggagatttctttttgtttccctttggtaattttcaaatattgttcctgtaataaaagttttagttagcttcaacatctaagtgtatggatgatactgaccacacatgttgttttgcttatccatttcaagtgcaagtgtttgccattttgtaaaacattttgggaaatcttccatcttgctgtgatttgcaataggtattttcttggagaatgtaagaacttaacaataaagctgaactggtgttgtgaaacagagaaa

SEQ ID NO: 152495 - DNA, 1085 bp, Homo sapiens
  Payload ID: 9996
  Gene Symbol: MAGEA11
  Gene Name: melanoma antigen family A11
  ENST ID: ENST00000412632
  CDS Start-End: 200-1085
ctccagggtatgggtcaggacctcttctgaaatgggagtttaagacctacaatcagacaagggcagggagctgtcttgacccccagtggaggctgacaatttttttcctgtgtacactggacccctttcatagaggtgggtgctatgcaagtggagctggtgactgatggctgaccattgatacaggctaggaataccaatgagcaaggtgagcactatgttctcagaggacgacttccagtcaacagaaagagccccatatggtccacaactacagtggtcccaggatctgccaagagtccaggtttttagagaacaggccaacctggaggacaggagtcccaggagaacccagaggatcactggaggagaacaagtgctgtggggccccatcacccagatatttcccacagttcggcctgctgacctaaccagagtcatcatgcctcttgagcaaagaagtcagcactgcaagcctgaggaaggccttcaggcccaagaagaagacctgggcctggtgggtgcacaggctctccaagctgaggagcaggaggctgccttcttctcctctactctgaatgtgggcactctagaggagttgcctgctgctgagtcaccaagtcctccccagagtcctcaggaagagtccttctctcccactgccatggatgccatctttgggagcctatctgatgagggctctggcagccaagaaaaggaggggccaagtacctcgcctgacctgatagaccctgagtccttttcccaagatatactacatgacaagataattgatttggttcatttattgctccgcaagtatcgagtcaaggggctgatcacaaaggcagaaatgctggggagtgtcatcaaaaattatgaggactactttcctgagatatttagggaagcctctgtatgcatgcaactgctctttggcattgatgtgaaggaagtggaccccactagccactcctatgtccttgtcacctccctcaacctctcttatgatggcatacagtgtaatgagcagagcatgcccaagtctggcctcctgataatagtcctgggtgtaatcttcatgg

SEQ ID NO: 152496 - DNA, 1664 bp, Homo sapiens
  Payload ID: 9997
  Gene Symbol: MAGEA12
  Gene Name: melanoma antigen family A12
  Uniprot ID: P43365
  ENST ID: ENST00000357916
  CDS Start-End: 157-1101
agagaacagcgagattctcgccctgagcaacggcctgacgtcggtggagggaagcaggcgcaggctccgtgaggaggcaaggttctgaggagacaggccccggagcagcactagctcctgcccacactcctacctgctgccctgaccagagtcatcatgccacttgagcagaggagtcagcactgcaagcctgaggaaggccttgaggcccaaggagaggccctgggcttggtgggtgcgcaggctcctgctactgaggagcaggagactgcctcctcctcctctactctagtggaagtcaccctgcgggaggtgcctgctgccgagtcaccaagtcctccccacagtcctcagggagcctccaccctccccactaccatcaactatactctctggagtcaatccgatgagggctccagcaacgaagaacaggaagggccaagcacctttcctgacctggagacgagcttccaagtagcactcagtaggaagatggctgagttggttcattttctgctcctcaagtatcgagccagggagccattcacaaaggcagaaatgctggggagtgtcatcagaaatttccaggacttctttcctgtgatcttcagcaaagcctccgagtacttgcagctggtctttggcatcgaggtggtggaagtggtccgcatcggccacttgtacatccttgtcacctgcctgggcctctcctacgatggcctgctgggcgacaatcagatcgtgcccaagacaggcctcctgataatcgtcctggccataatcgcaaaagagggcgactgtgcccctgaggagaaaatctgggaggagctgagtgtgttggaggcatctgatgggagggaggacagtgtctttgcgcatcccaggaagctgctcacccaagatttggtgcaggaaaactacctggagtaccggcaggtccccggcagtgatcctgcatgctacgagttcctgtggggtccaagggccctcgttgaaaccagctatgtgaaagtcctgcaccatttgctaaagatcagtggaggacctcacatttcctacccacccctgcatgaatgggcttttagagagggggaagagtgagtctgagcacgagttgcagccagggccagtgggagggggtctgggccagtgcaccttccaaggccccatccattagtttccactgcctcgtgtgacatgaggcccattcttcactctttgaagagagcagtcagtattgttagtagtgagtttctgttctattggatgactttgagatttatctttgtttcctgttggaattgttcaaatgttccttttaacggatggttgaatgaacttcagcatccaagtttatgaatgacagtagtcacacatagtgctgtttatatagtttaggagtaagagtgttgttttttattcagattgggaaatccattccattttgtgaattgtgacaaataacagcagtggaaaaagtatgtgcttagaattgtgaaagaattagcagtaaaatacatgagataaagacctcaagaagttaaaagatacttaattcttgccttatacctcactctattctgtaaatttgaaaaaaaagcatggatacctggatatccttggcttctttgagaatttaagagaaattaaatctgaataaataa

SEQ ID NO: 152497 - DNA, 1761 bp, Homo sapiens
  Payload ID: 9997
  Gene Symbol: MAGEA12
  Gene Name: melanoma antigen family A12
  Uniprot ID: P43365
  ENST ID: ENST00000393869
  CDS Start-End: 263-1207
agagaacagcgagattctcgccctgagcaacggcctgacgtcggtggagggaagcaggcgcaggctccgtgaggaggcaagatctcagggagttgaggaccttttcttcagagggtgactcaggtcaacacaggggcccccatgtagtcgacagacacagtggtcctaagatctaccaagcatccaggttctgaggagacaggccccggagcagcactagctcctgcccacactcctacctgctgccctgaccagagtcatcatgccacttgagcagaggagtcagcactgcaagcctgaggaaggccttgaggcccaaggagaggccctgggcttggtgggtgcgcaggctcctgctactgaggagcaggagactgcctcctcctcctctactctagtggaagtcaccctgcgggaggtgcctgctgccgagtcaccaagtcctccccacagtcctcagggagcctccaccctccccactaccatcaactatactctctggagtcaatccgatgagggctccagcaacgaagaacaggaagggccaagcacctttcctgacctggagacgagcttccaagtagcactcagtaggaagatggctgagttggttcattttctgctcctcaagtatcgagccagggagccattcacaaaggcagaaatgctggggagtgtcatcagaaatttccaggacttctttcctgtgatcttcagcaaagcctccgagtacttgcagctggtctttggcatcgaggtggtggaagtggtccgcatcggccacttgtacatccttgtcacctgcctgggcctctcctacgatggcctgctgggcgacaatcagatcgtgcccaagacaggcctcctgataatcgtcctggccataatcgcaaaagagggcgactgtgcccctgaggagaaaatctgggaggagctgagtgtgttggaggcatctgatgggagggaggacagtgtctttgcgcatcccaggaagctgctcacccaagatttggtgcaggaaaactacctggagtaccggcaggtccccggcagtgatcctgcatgctacgagttcctgtggggtccaagggccctcgttgaaaccagctatgtgaaagtcctgcaccatttgctaaagatcagtggaggacctcacatttcctacccacccctgcatgaatgggcttttagagagggggaagagtgagtctgagcacgagttgcagccagggccagtgggagggggtctgggccagtgcaccttccaaggccccatccattagtttccactgcctcgtgtgacatgaggcccattcttcactctttgaagagagcagtcagtattgttagtagtgagtttctgttctattggatgactttgagatttatctttgtttcctgttggaattgttcaaatgttccttttaacggatggttgaatgaacttcagcatccaagtttatgaatgacagtagtcacacatagtgctgtttatatagtttaggagtaagagtgttgttttttattcagattgggaaatccattccattttgtgaattgtgacaaataacagcagtggaaaaagtatgtgcttagaattgtgaaagaattagcagtaaaatacatgagataaagacctcaagaagttaaaagatacttaattcttgccttatacctcactctattctgtaaatttgaaaaaaaagcatggatacctggatatccttggcttctttgagaatttaagagaaattaaatctg

SEQ ID NO: 152498 - DNA, 1853 bp, Homo sapiens
  Payload ID: 9997
  Gene Symbol: MAGEA12
  Gene Name: melanoma antigen family A12
  Uniprot ID: P43365
  ENST ID: ENST00000393900
  CDS Start-End: 355-1299
aagatgccgagggaggactgaggcgggcctcaccccagacagagggcccccaataatccagcgctgcctctgctgccgggcctggaccaccctgcaggggaagacttctcaggctgagtcgccaccacctcaccccgccaccccccgccgctttaaccgcagggaactctggtatctcagggagttgaggaccttttcttcagagggtgactcaggtcaacacaggggcccccatgtagtcgacagacacagtggtcctaagatctaccaagcatccaggttctgaggagacaggccccggagcagcactagctcctgcccacactcctacctgctgccctgaccagagtcatcatgccacttgagcagaggagtcagcactgcaagcctgaggaaggccttgaggcccaaggagaggccctgggcttggtgggtgcgcaggctcctgctactgaggagcaggagactgcctcctcctcctctactctagtggaagtcaccctgcgggaggtgcctgctgccgagtcaccaagtcctccccacagtcctcagggagcctccaccctccccactaccatcaactatactctctggagtcaatccgatgagggctccagcaacgaagaacaggaagggccaagcacctttcctgacctggagacgagcttccaagtagcactcagtaggaagatggctgagttggttcattttctgctcctcaagtatcgagccagggagccattcacaaaggcagaaatgctggggagtgtcatcagaaatttccaggacttctttcctgtgatcttcagcaaagcctccgagtacttgcagctggtctttggcatcgaggtggtggaagtggtccgcatcggccacttgtacatccttgtcacctgcctgggcctctcctacgatggcctgctgggcgacaatcagatcgtgcccaagacaggcctcctgataatcgtcctggccataatcgcaaaagagggcgactgtgcccctgaggagaaaatctgggaggagctgagtgtgttggaggcatctgatgggagggaggacagtgtctttgcgcatcccaggaagctgctcacccaagatttggtgcaggaaaactacctggagtaccggcaggtccccggcagtgatcctgcatgctacgagttcctgtggggtccaagggccctcgttgaaaccagctatgtgaaagtcctgcaccatttgctaaagatcagtggaggacctcacatttcctacccacccctgcatgaatgggcttttagagagggggaagagtgagtctgagcacgagttgcagccagggccagtgggagggggtctgggccagtgcaccttccaaggccccatccattagtttccactgcctcgtgtgacatgaggcccattcttcactctttgaagagagcagtcagtattgttagtagtgagtttctgttctattggatgactttgagatttatctttgtttcctgttggaattgttcaaatgttccttttaacggatggttgaatgaacttcagcatccaagtttatgaatgacagtagtcacacatagtgctgtttatatagtttaggagtaagagtgttgttttttattcagattgggaaatccattccattttgtgaattgtgacaaataacagcagtggaaaaagtatgtgcttagaattgtgaaagaattagcagtaaaatacatgagataaagacctcaagaagttaaaagatacttaattcttgccttatacctcactctattctgtaaatttgaaaaaaaagcatggatacctggatatccttggcttctttgagaatttaagagaaattaaatctg

SEQ ID NO: 152499 - DNA, 1662 bp, Homo sapiens
  Payload ID: 9998
  Gene Symbol: MAGEA2
  Gene Name: melanoma antigen family A2
  Uniprot ID: P43356
  ENST ID: ENST00000598543
  CDS Start-End: 163-1107
ttgcgcattggaggtcagaggacagcgagattctcgccctgagcaacggcctgacgtcggcggagggaagcaggcgcaggctccgtgaggaggcaaggcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttc

SEQ ID NO: 152500 - DNA, 1830 bp, Homo sapiens
  Payload ID: 9998
  Gene Symbol: MAGEA2
  Gene Name: melanoma antigen family A2
  Uniprot ID: P43356
  ENST ID: ENST00000595583
  CDS Start-End: 343-1287
attggaggtcagaggacagcgagattctcgccctgagcaacggcctgacgtcggcggagggaagcaggcgcaggctccgtgaggaggcaagatctcagggagttgatgaccttgttttcagaaggtgactcaggtcaacacaggggcccccatctggtcgacagatgcagtggttctaggatctgccaagcatccaggtggagagcctgaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataa

SEQ ID NO: 152501 - DNA, 1728 bp, Homo sapiens
  Payload ID: 9998
  Gene Symbol: MAGEA2
  Gene Name: melanoma antigen family A2
  Uniprot ID: P43356
  ENST ID: ENST00000611674
  CDS Start-End: 229-1173
ttgcgcattggaggtcagaggacagcgagattctcgccctgagcaacggcctgacgtcggcggagggaagcaggcgcaggctccgtgaggaggcaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttc

SEQ ID NO: 152502 - DNA, 2024 bp, Homo sapiens
  Payload ID: 9998
  Gene Symbol: MAGEA2
  Gene Name: melanoma antigen family A2
  Uniprot ID: P43356
  ENST ID: ENST00000611557
  CDS Start-End: 524-1468
ttgcgcattggaggtcagaggacagcgagattctcgccctgagcaacggcctgacgtcggcggagggaagcaggcgcaggctccgtgaggaggcaaggtaagacgccgagggaggactgaggcgggcctcaccccagacagagggcccccaataatccagcgctgcctctgctgccgggcctggaccaccctgcaggggaagacttctcaggctgagtcgccaccacctcaccccgccaccccccgccgctttaaccgcagggaactctggcatctcagggagttgatgaccttgttttcagaaggtgactcaggtcaacacaggggcccccatctggtcgacagatgcagtggttctaggatctgccaagcatccaggtggagagcctgaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttca

SEQ ID NO: 152503 - DNA, 725 bp, Homo sapiens
  Payload ID: 9998
  Gene Symbol: MAGEA2
  Gene Name: melanoma antigen family A2
  ENST ID: ENST00000617846
  CDS Start-End: 484-725
gcaacggcctgacgtcggcggagggaagcaggcgcaggctccgtgaggaggcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggaatcaggagctccaggaaccaggcagtgaggccttggtctgagtcagtgtcctcaggtcacagagcagaggggacgcagacagtgccaacactgaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggag

SEQ ID NO: 152504 - DNA, 576 bp, Homo sapiens
  Payload ID: 9998
  Gene Symbol: MAGEA2
  Gene Name: melanoma antigen family A2
  ENST ID: ENST00000617505
  CDS Start-End: 466-576
aacggcctgacgtcggcggagggaagcaggcgcaggctccgtgaggaggcaagggaactctggcgtaagagctttgtgtgaccagggcagggctggttagaagtgctcagggcccagactcagccaggaatcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcag

SEQ ID NO: 152505 - DNA, 1947 bp, Homo sapiens
  Payload ID: 9998
  Gene Symbol: MAGEA2
  Gene Name: melanoma antigen family A2
  Uniprot ID: P43356
  ENST ID: ENST00000620710
  CDS Start-End: 447-1391
ttgcgcattggaggtcagaggacagcgagattctcgccctgagcaacggcctgacgtcggcggagggaagcaggcgcaggctccgtgaggaggcaagatctcagggagttgatgaccttgttttcagaaggtgactcaggtcaacacaggggcccccatctggtcgacagatgcagtggttctaggatctgccaagcatccaggtggagagcctgaggaatcaggagctccaggaaccaggcagtgaggccttggtctgagtcagtgtcctcaggtcacagagcagaggggacgcagacagtgccaacactgaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttca

SEQ ID NO: 152506 - DNA, 2009 bp, Homo sapiens
  Payload ID: 9998
  Gene Symbol: MAGEA2
  Gene Name: melanoma antigen family A2
  Uniprot ID: P43356
  ENST ID: ENST00000623438
  CDS Start-End: 510-1454
ttgcgcattggaggtcagaggacagcgagattctcgccctgagcaacggcctgacgtcggcggagggaagcaggcgcaggctccgtgaggaggcaagggaactctggcgtaagagctttgtgtgaccagggcagggctggttagaagtgctcagggcccagactcagccaggaatcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttc

SEQ ID NO: 152507 - DNA, 2025 bp, Homo sapiens
  Payload ID: 9998
  Gene Symbol: MAGEA2
  Gene Name: melanoma antigen family A2
  Uniprot ID: P43356
  ENST ID: ENST00000623806
  CDS Start-End: 526-1470
ttgcgcattggaggtcagaggacagcgagattctcgccctgagcaacggcctgacgtcggcggagggaagcaggcgcaggctccgtgaggaggcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggaatcaggagctccaggaaccaggcagtgaggccttggtctgagtcagtgtcctcaggtcacagagcagaggggacgcagacagtgccaacactgaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttc

SEQ ID NO: 152508 - DNA, 1946 bp, Homo sapiens
  Payload ID: 9999
  Gene Symbol: MAGEA2B
  Gene Name: melanoma antigen family A2B
  Uniprot ID: P43356
  ENST ID: ENST00000331220
  CDS Start-End: 447-1391
ttgcgcattggaggtcagaggacagcgagattctcgccctgagcaacggcctgacgtcggcggagggaagcaggcgcaggctccgtgaggaggcaagatctcagggagttgatgaccttgttttcagaaggtgactcaggtcaacacaggggcccccatctggtcgacagatgcagtggttctaggatctgccaagcatccaggtggagagcctgaggaatcaggagctccaggaaccaggcagtgaggccttggtctgagtcagtgtcctcaggtcacagagcagaggggacgcagacagtgccaacactgaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttc

SEQ ID NO: 152509 - DNA, 1714 bp, Homo sapiens
  Payload ID: 9999
  Gene Symbol: MAGEA2B
  Gene Name: melanoma antigen family A2B
  Uniprot ID: P43356
  ENST ID: ENST00000370293
  CDS Start-End: 214-1158
cagaggacagcgagattctcgccctgagcaacggcctgacgtcggcggagggaagcaggcgcaggctccgtgaggaggcaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttca

SEQ ID NO: 152510 - DNA, 445 bp, Homo sapiens
  Payload ID: 9999
  Gene Symbol: MAGEA2B
  Gene Name: melanoma antigen family A2B
  ENST ID: ENST00000409560
  CDS Start-End: 345-445
aagacgccgagggaggactgaggcgggcctcaccccagacagagggcccccaataatccagcgctgcctctgctgccgggcctggaccaccctgcaggggaagacttctcaggctgagtcgccaccacctcaccccgccaccccccgccgctttaaccgcagggaactctggcatctcagggagttgatgaccttgttttcagaaggtgactcaggtcaacacaggggcccccatctggtcgacagatgcagtggttctaggatctgccaagcatccaggcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactga

SEQ ID NO: 152511 - DNA, 750 bp, Homo sapiens
  Payload ID: 9999
  Gene Symbol: MAGEA2B
  Gene Name: melanoma antigen family A2B
  ENST ID: ENST00000447530
  CDS Start-End: 484-750
gcaacggcctgacgtcggcggagggaagcaggcgcaggctccgtgaggaggcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggaatcaggagctccaggaaccaggcagtgaggccttggtctgagtcagtgtcctcaggtcacagagcagaggggacgcagacagtgccaacactgaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaac

SEQ ID NO: 152512 - DNA, 576 bp, Homo sapiens; identical to SEQ ID NO: 152504
  Payload ID: 9999
  Gene Symbol: MAGEA2B
  Gene Name: melanoma antigen family A2B
  ENST ID: ENST00000458057
  CDS Start-End: 466-576

SEQ ID NO: 152513 - DNA, 879 bp, Homo sapiens
  Payload ID: 9999
  Gene Symbol: MAGEA2B
  Gene Name: melanoma antigen family A2B
  ENST ID: ENST00000423993
  CDS Start-End: 424-879
agcgagattctcgccctgagcaacggcctgacgtcggcggagggaagcaggcgcaggctccgtgaggaggcaagatctcagggagttgatgaccttgttttcagaaggtgactcaggtcaacacaggggcccccatctggtcgacagatgcagtggttctaggatctgccaagcatccaggtggagagcctgaggaatcaggagctccaggaaccaggcagtgaggccttggtctgagtcagtgtcctcaggtcacagagcagaggggacgcagacagtgccaacactgaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagc

SEQ ID NO: 152514 - DNA, 652 bp, Homo sapiens
  Payload ID: 9999
  Gene Symbol: MAGEA2B
  Gene Name: melanoma antigen family A2B
  ENST ID: ENST00000422085
  CDS Start-End: 293-652
tcggcggagggaagcaggcgcaggctccgtgaggaggcaagatctcagggagttgatgaccttgttttcagaaggtgactcaggtcaacacaggggcccccatctggtcgacagatgcagtggttctaggatctgccaagcatccaggtggagagcctgaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctg

SEQ ID NO: 152515 - DNA, 753 bp, Homo sapiens
  Payload ID: 9999
  Gene Symbol: MAGEA2B
  Gene Name: melanoma antigen family A2B
  ENST ID: ENST00000453150
  CDS Start-End: 309-753
aggtaagacgccgagggaggactgaggcgggcctcaccccagacagagggcccccaataatccagcgctgcctctgctgccgggcctggaccaccctgcaggggaagacttctcaggctgagtcgccaccacctcaccccgccaccccccgccgctttaaccgcagggaactctggcgttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccg

SEQ ID NO: 152516 - DNA, 1724 bp, Homo sapiens
  Payload ID: 10000
  Gene Symbol: MAGEA3
  Gene Name: melanoma antigen family A3
  Uniprot ID: P43357
  ENST ID: ENST00000370278
  CDS Start-End: 210-1154
gagattctcgccctgagcaacgagcgacggcctgacgtcggcggagggaagccggcccaggctcggtgaggaggcaaggttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtccgagttccaagcagcactcagtaggaaggtggccgagttggttcattttctgctcctcaagtatcgagccagggagccggtcacaaaggcagaaatgctggggagtgtcgtcggaaattggcagtatttctttcctgtgatcttcagcaaagcttccagttccttgcagctggtctttggcatcgagctgatggaagtggaccccatcggccacttgtacatctttgccacctgcctgggcctctcctacgatggcctgctgggtgacaatcagatcatgcccaaggcaggcctcctgataatcgtcctggccataatcgcaagagagggcgactgtgcccctgaggagaaaatctgggaggagctgagtgtgttagaggtgtttgaggggagggaagacagtatcttgggggatcccaagaagctgctcacccaacatttcgtgcaggaaaactacctggagtaccggcaggtccccggcagtgatcctgcatgttatgaattcctgtggggtccaagggccctcgttgaaaccagctatgtgaaagtcctgcaccatatggtaaagatcagtggaggacctcacatttcctacccacccctgcatgagtgggttttgagagagggggaagagtgagtctgagcacgagttgcagccagggccagtgggagggggtctgggccagtgcaccttccggggccgcatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttactcaaattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttca

SEQ ID NO: 152517 - DNA, 853 bp, Homo sapiens
  Payload ID: 10000
  Gene Symbol: MAGEA3
  Gene Name: melanoma antigen family A3
  ENST ID: ENST00000417212
  CDS Start-End: 259-853
agcaacgagcgacggcctgacgtcggcggagggaagccggcccaggctcggtgaggaggcaagtcctgcagcctcagcatgcgctggccggatgtaccctgaggtgccctctcacttcctccttcaggttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtccgagttccaagcagcactcagtaggaaggtggccgagttggttcattttctgctcctcaagtatcgagccagggagccggtcacaaaggcagaaatgctggggagtgtcgtcggaaattggcagtatttctttcctgtgatcttcagcaaagcttccagttccttgcagctggtctttggcatcgagctgatggaagtggaccccatcggccacttgtacatctttgccacctgcctgggcctctcctacgatggcctgctgggtgacaatcagatcatgcccaagg

SEQ ID NO: 152518 - DNA, 1762 bp, Homo sapiens
  Payload ID: 10000
  Gene Symbol: MAGEA3
  Gene Name: melanoma antigen family A3
  Uniprot ID: P43357
  ENST ID: ENST00000598245
  CDS Start-End: 259-1203
agcaacgagcgacggcctgacgtcggcggagggaagccggcccaggctcggtgaggaggcaagtcctgcagcctcagcatgcgctggccggatgtaccctgaggtgccctctcacttcctccttcaggttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtccgagttccaagcagcactcagtaggaaggtggccgagttggttcattttctgctcctcaagtatcgagccagggagccggtcacaaaggcagaaatgctggggagtgtcgtcggaaattggcagtatttctttcctgtgatcttcagcaaagcttccagttccttgcagctggtctttggcatcgagctgatggaagtggaccccatcggccacttgtacatctttgccacctgcctgggcctctcctacgatggcctgctgggtgacaatcagatcatgcccaaggcaggcctcctgataatcgtcctggccataatcgcaagagagggcgactgtgcccctgaggagaaaatctgggaggagctgagtgtgttagaggtgtttgaggggagggaagacagtatcttgggggatcccaagaagctgctcacccaacatttcgtgcaggaaaactacctggagtaccggcaggtccccggcagtgatcctgcatgttatgaattcctgtggggtccaagggccctcgttgaaaccagctatgtgaaagtcctgcaccatatggtaaagatcagtggaggacctcacatttcctacccacccctgcatgagtgggttttgagagagggggaagagtgagtctgagcacgagttgcagccagggccagtgggagggggtctgggccagtgcaccttccggggccgcatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttactcaaattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataatt

SEQ ID NO: 152519 - DNA, 1724 bp, Homo sapiens
  Payload ID: 10001
  Gene Symbol: MAGEA4
  Gene Name: melanoma antigen family A4
  Uniprot ID: P43358
  ENST ID: ENST00000276344
  CDS Start-End: 219-1172
agagacaagcgagcttctgcgtctgactcgcagcttgagactggcggagggaagcccgcccaggctctataaggagacaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaa

SEQ ID NO: 152520 - DNA, 1773 bp, Homo sapiens
  Payload ID: 10001
  Gene Symbol: MAGEA4
  Gene Name: melanoma antigen family A4
  Uniprot ID: P43358
  ENST ID: ENST00000360243
  CDS Start-End: 268-1221
agaaagcctcaggggcccggatgtgatgccactgacttgcgcattgggggttagagagaagcgagctgctgtctgaccagcagcttgggattggtggaaggaagcaggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaa

SEQ ID NO: 152521 - DNA, 1773 bp, Homo sapiens; identical to SEQ ID NO: 152520
  Payload ID: 10001
  Gene Symbol: MAGEA4
  Gene Name: melanoma antigen family A4
  Uniprot ID: P43358
  ENST ID: ENST00000370335
  CDS Start-End: 268-1221

SEQ ID NO: 152522 - DNA, 1773 bp, Homo sapiens; identical to SEQ ID NO: 152520
  Payload ID: 10001
  Gene Symbol: MAGEA4
  Gene Name: melanoma antigen family A4
  Uniprot ID: P43358
  ENST ID: ENST00000370340
  CDS Start-End: 268-1221

SEQ ID NO: 152523 - DNA, 1721 bp, Homo sapiens
  Payload ID: 10001
  Gene Symbol: MAGEA4
  Gene Name: melanoma antigen family A4
  Uniprot ID: P43358
  ENST ID: ENST00000393920
  CDS Start-End: 216-1169
ttagagagaagcgagctgctctgaccagccgcttgggattggcggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaa

SEQ ID NO: 152524 - DNA, 1727 bp, Homo sapiens
  Payload ID: 10001
  Gene Symbol: MAGEA4
  Gene Name: melanoma antigen family A4
  Uniprot ID: P43358
  ENST ID: ENST00000393921
  CDS Start-End: 222-1175
ggttagagagaagcgagctgctctgtctgaccagcagcttgggattggcggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatggggagcccaggaaactgctcacccaagattgggtgcaggaaaactacctggagtaccggcaggtacccggcagtaatcctgcgcgctatgagttcctgtggggtccaagggctctggctgaaaccagctatgtgaaagtcctggagcatgtggtcagggtcaatgcaagagttcgcattgcctacccatccctgcgtgaagcagctttgttagaggaggaagagggagtctgagcatgagttgcagccagggctgtggggaaggggcagggctgggccagtgcatctaacagccctgtgcagcagcttcccttgcctcgtgtaacatgaggcccattcttcactctgtttgaagaaaatagtcagtgttcttagtagtgggtttctattttgttggatgacttggagatttatctctgtttccttttacaattgttgaaatgttccttttaatggatggttgaattaacttcagcatccaagtttatgaatcgtagttaacgtatattgctgttaatatagtttaggagtaagagtcttgttttttattcagattgggaaatccgttctattttgtgaatttgggacataataacagcagtggagtaagtatttagaagtgtgaattcaccgtgaaataggtgagataaattaaaagatacttaattcccgccttatgcctcagtctattctgtaaaatttaaaaaatatatatgcatacctggatttccttggcttcgtgaatgtaagagaaattaaatctgaataaataattctttctgttaa

SEQ ID NO: 152525 - DNA, 854 bp, Homo sapiens
  Payload ID: 10001
  Gene Symbol: MAGEA4
  Gene Name: melanoma antigen family A4
  ENST ID: ENST00000431963
  CDS Start-End: 340-854
agggaagcaggcgcaggctctgtgaggaggcaaggcaggatccccggttccgcccccgctttcaaccaaggaaagccccagctgcccggatgtgatgccactgacttgcgcactgggggttagagacaagcgagcttctgcgtctgactcgcagcttgagactggcggagggaagcccgcccaggctctataaggagacaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccc

SEQ ID NO: 152526 - DNA, 997 bp, Homo sapiens
  Payload ID: 10001
  Gene Symbol: MAGEA4
  Gene Name: melanoma antigen family A4
  ENST ID: ENST00000431971
  CDS Start-End: 274-997
aacccaagaaagccccaggggcccggatgtgatgccactgacttgcgcattcggggttagagagaagcgagctgctctgtgaccagccgcttgggattggtggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatgggg

SEQ ID NO: 152527 - DNA, 914 bp, Homo sapiens
  Payload ID: 10001
  Gene Symbol: MAGEA4
  Gene Name: melanoma antigen family A4
  ENST ID: ENST00000448295
  CDS Start-End: 264-914
ccccaggggcccggatgtgatgccactgacttgcgcattgggggttagagagaagcgagctgctctgtctgaccagcagcttgggattggcggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcc

SEQ ID NO: 152528 - DNA, 1029 bp, Homo sapiens
  Payload ID: 10001
  Gene Symbol: MAGEA4
  Gene Name: melanoma antigen family A4
  ENST ID: ENST00000416020
  CDS Start-End: 339-1029
ccccaggggcccggatgtgatgccactgacttgcgcattgggggttagagagaagcgagctgctctgtctgaccagcagcttgggattggcggagggaagcgggccaggccctgtgaggagtcaaggttctgagcagacaggccaaccggaggacaggattccctggaggccacagaggagcaccaaggagaagatctgtaagtaagcctttgttagagcctctaagatttggttctcagctgaggtctctcacatgctccctctctccgtaggcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatggggg

SEQ ID NO: 152529 - DNA, 986 bp, Homo sapiens
  Payload ID: 10001
  Gene Symbol: MAGEA4
  Gene Name: melanoma antigen family A4
  ENST ID: ENST00000430273
  CDS Start-End: 263-986
cccaggggcccggatgtgatgccactgacttgcgcattgggggttagagagaagcgagctgctctgtctgaccagcagcttgggattggcggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatgggg

SEQ ID NO: 152530 - DNA, 914 bp, Homo sapiens; identical to SEQ ID NO: 152527
  Payload ID: 10001
  Gene Symbol: MAGEA4
  Gene Name: melanoma antigen family A4
  ENST ID: ENST00000425182
  CDS Start-End: 264-914

SEQ ID NO: 152531 - DNA, 990 bp, Homo sapiens
  Payload ID: 10001
  Gene Symbol: MAGEA4
  Gene Name: melanoma antigen family A4
  ENST ID: ENST00000457310
  CDS Start-End: 267-990
aagaaagtcccaggtgcccggatgtgatgccactgacttgcgcattgggggttagagagaagcgagctgctctgaccagccgcttgggattggcggagggaagcgggccaggccctgtgaggagtcaaggttctgagcagacaggccaaccggaggacaggattccctggaggccacagaggagcaccaaggagaagatctgcctgtgggtccccattgcccagcttttgcctgcactcttgcctgctgccctgaccagagtcatcatgtcttctgagcagaagagtcagcactgcaagcctgaggaaggcgttgaggcccaagaagaggccctgggcctggtgggtgcacaggctcctactactgaggagcaggaggctgctgtctcctcctcctctcctctggtccctggcaccctggaggaagtgcctgctgctgagtcagcaggtcctccccagagtcctcagggagcctctgccttacccactaccatcagcttcacttgctggaggcaacccaatgagggttccagcagccaagaagaggaggggccaagcacctcgcctgacgcagagtccttgttccgagaagcactcagtaacaaggtggatgagttggctcattttctgctccgcaagtatcgagccaaggagctggtcacaaaggcagaaatgctggagagagtcatcaaaaattacaagcgctgctttcctgtgatcttcggcaaagcctccgagtccctgaagatgatctttggcattgacgtgaaggaagtggaccccgccagcaacacctacacccttgtcacctgcctgggcctttcctatgatggcctgctgggtaataatcagatctttcccaagacaggccttctgataatcgtcctgggcacaattgcaatggagggcgacagcgcctctgaggaggaaatctgggaggagctgggtgtgatgggggtgtatgatgggagggagcacactgtctatgggg

SEQ ID NO: 152532 - DNA, 990 bp, Homo sapiens; identical to SEQ ID NO: 152531
  Payload ID: 10001
  Gene Symbol: MAGEA4
  Gene Name: melanoma antigen family A4
  ENST ID: ENST00000441865
  CDS Start-End: 267-990

SEQ ID NO: 152533 - DNA, 1740 bp, Homo sapiens
  Payload ID: 10002
  Gene Symbol: MAGEA6
  Gene Name: melanoma antigen family A6
  Uniprot ID: P43360
  ENST ID: ENST00000329342
  CDS Start-End: 226-1170
gaggtcagaagaccgcgagattctcgccctgagcaacgagcgacggcctgacgtcggcggagggaagccggcccaggctcggtgaggaggcaaggttctgaggggacaggctgacgtggaggaacagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtctgagttccaagcagcactcagtaggaaggtggccaagttggttcattttctgctcctcaagtatcgagccagggagccggtcacaaaggcagaaatgctggggagtgtcgtcggaaattggcagtacttctttcctgtgatcttcagcaaagcttccgattccttgcagctggtctttggcatcgagctgatggaagtggaccccatcggccacgtgtacatctttgccacctgcctgggcctctcctacgatggcctgctgggtgacaatcagatcatgcccaagacaggcttcctgataatcatcctggccataatcgcaaaagagggcgactgtgcccctgaggagaaaatctgggaggagctgagtgtgttagaggtgtttgaggggagggaagacagtatcttcggggatcccaagaagctgctcacccaatatttcgtgcaggaaaactacctggagtaccggcaggtccccggcagtgatcctgcatgctatgagttcctgtggggtccaagggccctcattgaaaccagctatgtgaaagtcctgcaccatatggtaaagatcagtggaggacctcgcatttcctacccactcctgcatgagtgggctttgagagagggggaagagtgagtctgagcacgagttgcagccagggccagtgggagggggtttgggccagtgcaccttccggggccccatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttattcagattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttca

SEQ ID NO: 152534 - DNA, 921 bp, Homo sapiens
  Payload ID: 10002
  Gene Symbol: MAGEA6
  Gene Name: melanoma antigen family A6
  ENST ID: ENST00000457643
  CDS Start-End: 215-921
gcccaggctcggtgaggaggcaagaatccgggctttgcccctggtatcaagtcacggaagctccgggaatggcggccaggcacgttctgaggggacaggctgacgtggaggaacagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtctgagttccaagcagcactcagtaggaaggtggccaagttggttcattttctgctcctcaagtatcgagccagggagccggtcacaaaggcagaaatgctggggagtgtcgtcggaaattggcagtacttctttcctgtgatcttcagcaaagcttccgattccttgcagctggtctttggcatcgagctgatggaagtggaccccatcggccacgtgtacatctttgccacctgcctgggcctctcctacgatggcctgctgggtgacaatcagatcatgcccaagacaggcttcctgataatcatcctggccataatcgcaaaagagggcgactgtgcccctgaggagaaaatctgggaggagctgagtgtgttagaggtgtttgaggggagggaaga

SEQ ID NO: 152535 - DNA, 862 bp, Homo sapiens
  Payload ID: 10002
  Gene Symbol: MAGEA6
  Gene Name: melanoma antigen family A6
  ENST ID: ENST00000412733
  CDS Start-End: 259-862
agcaacgagcgacggcctgacgtcggcggagggaagccggcccaggctcggtgaggaggcaagtcctgcagcctcagcatgtgctggccggatgtaccctgaggtgccctctcacttcctccttcaggttctgaggggacaggctgacgtggaggaacagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtctgagttccaagcagcactcagtaggaaggtggccaagttggttcattttctgctcctcaagtatcgagccagggagccggtcacaaaggcagaaatgctggggagtgtcgtcggaaattggcagtacttctttcctgtgatcttcagcaaagcttccgattccttgcagctggtctttggcatcgagctgatggaagtggaccccatcggccacgtgtacatctttgccacctgcctgggcctctcctacgatggcctgctgggtgacaatcagatcatgcccaagacaggcttcc

SEQ ID NO: 152536 - DNA, 1762 bp, Homo sapiens
  Payload ID: 10002
  Gene Symbol: MAGEA6
  Gene Name: melanoma antigen family A6
  Uniprot ID: P43360
  ENST ID: ENST00000616035
  CDS Start-End: 259-1203
agcaacgagcgacggcctgacgtcggcggagggaagccggcccaggctcggtgaggaggcaagtcctgcagcctcagcatgtgctggccggatgtaccctgaggtgccctctcacttcctccttcaggttctgaggggacaggctgacgtggaggaacagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtctgagttccaagcagcactcagtaggaaggtggccaagttggttcattttctgctcctcaagtatcgagccagggagccggtcacaaaggcagaaatgctggggagtgtcgtcggaaattggcagtacttctttcctgtgatcttcagcaaagcttccgattccttgcagctggtctttggcatcgagctgatggaagtggaccccatcggccacgtgtacatctttgccacctgcctgggcctctcctacgatggcctgctgggtgacaatcagatcatgcccaagacaggcttcctgataatcatcctggccataatcgcaaaagagggcgactgtgcccctgaggagaaaatctgggaggagctgagtgtgttagaggtgtttgaggggagggaagacagtatcttcggggatcccaagaagctgctcacccaatatttcgtgcaggaaaactacctggagtaccggcaggtccccggcagtgatcctgcatgctatgagttcctgtggggtccaagggccctcattgaaaccagctatgtgaaagtcctgcaccatatggtaaagatcagtggaggacctcgcatttcctacccactcctgcatgagtgggctttgagagagggggaagagtgagtctgagcacgagttgcagccagggccagtgggagggggtttgggccagtgcaccttccggggccccatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttattcagattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataatt

SEQ ID NO: 152537 - DNA, 1778 bp, Homo sapiens
  Payload ID: 10003
  Gene Symbol: MAGEA8
  Gene Name: melanoma antigen family A8
  Uniprot ID: P43361
  ENST ID: ENST00000286482
  CDS Start-End: 217-1173
gcggggatcagagagaagcgagggcctggttctgaggggtcggcttgagatcggctgagggaagcgggctcagggtctgtgaggaggcaaggttcgcagagaacaggccagccaggaggtcaggaggccccagagaagcactgaagaagacctgcctgtgggtctcaattgcccagctccggcccacactctcctgctgccctgacctgagtcatcatgcttcttgggcagaagagtcagcgctacaaggctgaggaaggccttcaggcccaaggagaggcaccagggcttatggatgtgcagattcccacagctgaggagcagaaggctgcatcctcctcctctactctgatcatgggaacccttgaggaggtgactgattctgggtcaccaagtcctccccagagtcctgagggtgcctcctcttccctgactgtcaccgacagcactctgtggagccaatccgatgagggttccagcagcaatgaagaggaggggccaagcacctccccggacccagctcacctggagtccctgttccgggaagcacttgatgagaaagtggctgagttagttcgtttcctgctccgcaaatatcaaattaaggagccggtcacaaaggcagaaatgcttgagagtgtcatcaaaaattacaagaaccactttcctgatatcttcagcaaagcctctgagtgcatgcaggtgatctttggcattgatgtgaaggaagtggaccctgccggccactcctacatccttgtcacctgcctgggcctctcctatgatggcctgctgggtgatgatcagagtacgcccaagaccggcctcctgataatcgtcctgggcatgatcttaatggagggcagccgcgccccggaggaggcaatctgggaagcgttgagtgtgatggggctgtatgatgggagggagcacagtgtctattggaagctcaggaagctgctcacccaagagtgggtgcaggagaactacctggagtaccgccaggcgcccggcagtgatcctgtgcgctacgagttcctgtggggtccaagggcccttgctgaaaccagctatgtgaaagtcctggagcatgtggtcagggtcaatgcaagagttcgcatttcctacccatccctgcatgaagaggctttgggagaggagaaaggagtttgagcaggagttgcagctagggccagtggggcaggttgtgggagggcctgggccagtgcacgttccagggccacatccaccactttccctgctctgttacatgaggcccattcttcactctgtgtttgaagagagcagtcacagttctcagtagtggggagcatgttgggtgtgagggaacacagtgtggaccatctctcagttcctgttctattgggcgatttggaggtttatctttgtttccttttggaattgttccaatgttccttctaatggatggtgtaatgaacttcaacattcattttatgtatgacagtagacagacttactgctttttatatagtttaggagtaagagtcttgcttttcatttatactgggaaacccatgttatttcttgaattcagacactacaagagcagaggattaaggtttttttagaaatgtgaaacaacatagcagtaaaatacatgagataaagacataaagaaattaaacaatagttaattcttgccttacctgtacctcttagtgtaccctatgtacctgaatttgcttggcttctttgagaatgaaattgaattaaatatgaataaataagtccccctg

SEQ ID NO: 152538 - DNA, 2112 bp, Homo sapiens
  Payload ID: 10003
  Gene Symbol: MAGEA8
  Gene Name: melanoma antigen family A8
  Uniprot ID: P43361
  ENST ID: ENST00000535454
  CDS Start-End: 550-1506
gttgtccacccaggtgagccctgggtggacggatgtgacgccactgacgtggccgcggggatcagagagaagcgagggcctggttctgaggggtcggcttgagatcggctgagggaagcgggctcagggtctgtgaggaggcaagcaggcaaaaaacagatgggggcccaacagaaatctgcccggcctcttttgtcacccctgagagcatgagcaggactatcagctgaggcccctgtgttataccagactcattggtctcagggagaagaaggccttggtctgagggcactgcattcaggtcagcagagcgggggtccaaggccctgccaggagtcagggactcagaggacaccactcaccaaacacacaggaccgaaccccaccctgcaccttctgtcagccatgggaagtgcagggaaaggttcgcagagaacaggccagccaggaggtcaggaggccccagagaagcactgaagaagacctgcctgtgggtctcaattgcccagctccggcccacactctcctgctgccctgacctgagtcatcatgcttcttgggcagaagagtcagcgctacaaggctgaggaaggccttcaggcccaaggagaggcaccagggcttatggatgtgcagattcccacagctgaggagcagaaggctgcatcctcctcctctactctgatcatgggaacccttgaggaggtgactgattctgggtcaccaagtcctccccagagtcctgagggtgcctcctcttccctgactgtcaccgacagcactctgtggagccaatccgatgagggttccagcagcaatgaagaggaggggccaagcacctccccggacccagctcacctggagtccctgttccgggaagcacttgatgagaaagtggctgagttagttcgtttcctgctccgcaaatatcaaattaaggagccggtcacaaaggcagaaatgcttgagagtgtcatcaaaaattacaagaaccactttcctgatatcttcagcaaagcctctgagtgcatgcaggtgatctttggcattgatgtgaaggaagtggaccctgccggccactcctacatccttgtcacctgcctgggcctctcctatgatggcctgctgggtgatgatcagagtacgcccaagaccggcctcctgataatcgtcctgggcatgatcttaatggagggcagccgcgccccggaggaggcaatctgggaagcgttgagtgtgatggggctgtatgatgggagggagcacagtgtctattggaagctcaggaagctgctcacccaagagtgggtgcaggagaactacctggagtaccgccaggcgcccggcagtgatcctgtgcgctacgagttcctgtggggtccaagggcccttgctgaaaccagctatgtgaaagtcctggagcatgtggtcagggtcaatgcaagagttcgcatttcctacccatccctgcatgaagaggctttgggagaggagaaaggagtttgagcaggagttgcagctagggccagtggggcaggttgtgggagggcctgggccagtgcacgttccagggccacatccaccactttccctgctctgttacatgaggcccattcttcactctgtgtttgaagagagcagtcacagttctcagtagtggggagcatgttgggtgtgagggaacacagtgtggaccatctctcagttcctgttctattgggcgatttggaggtttatctttgtttccttttggaattgttccaatgttccttctaatggatggtgtaatgaacttcaacattcattttatgtatgacagtagacagacttactgctttttatatagtttaggagtaagagtcttgcttttcatttatactgggaaacccatgttatttcttgaattcagacactacaagagcagaggattaaggtttttttagaaatgtgaaacaacatagcagtaaaatacatgagataaagacataaagaaattaaacaatagttaattcttgccttacctgtacctcttagtgtaccctatgtacctgaatttgcttggcttctttgagaatgaaattgaattaaatatgaataaataagtccccctgc

SEQ ID NO: 152539 - DNA, 2084 bp, Homo sapiens
  Payload ID: 10003
  Gene Symbol: MAGEA8
  Gene Name: melanoma antigen family A8
  Uniprot ID: P43361
  ENST ID: ENST00000542674
  CDS Start-End: 522-1478
gttgtccacccaggtgagccctgggtggacggatgtgacgccactgacgtggccgcggggatcagagagaagcgagggcctggttctgaggggtcggcttgagatcggctgagggaagcgggctcagggtctgtgaggaggcaaggagctccaggaaccaggctgtgaggtcttggtctgaggcagtatcttcaatcacagagcataagaggcccaggcagtagtagcagtcaagctgaggtggtgtttcccctgtatgtataccagaggcccctctggcatcagaacagcaggaaccccacagttcctggccctaccagcccttttgtcagtcctggagccttggcctttgccaggaggctgcaccctgagatgccctctcaatttctccttcaggttcgcagagaacaggccagccaggaggtcaggaggccccagagaagcactgaagaagacctgcctgtgggtctcaattgcccagctccggcccacactctcctgctgccctgacctgagtcatcatgcttcttgggcagaagagtcagcgctacaaggctgaggaaggccttcaggcccaaggagaggcaccagggcttatggatgtgcagattcccacagctgaggagcagaaggctgcatcctcctcctctactctgatcatgggaacccttgaggaggtgactgattctgggtcaccaagtcctccccagagtcctgagggtgcctcctcttccctgactgtcaccgacagcactctgtggagccaatccgatgagggttccagcagcaatgaagaggaggggccaagcacctccccggacccagctcacctggagtccctgttccgggaagcacttgatgagaaagtggctgagttagttcgtttcctgctccgcaaatatcaaattaaggagccggtcacaaaggcagaaatgcttgagagtgtcatcaaaaattacaagaaccactttcctgatatcttcagcaaagcctctgagtgcatgcaggtgatctttggcattgatgtgaaggaagtggaccctgccggccactcctacatccttgtcacctgcctgggcctctcctatgatggcctgctgggtgatgatcagagtacgcccaagaccggcctcctgataatcgtcctgggcatgatcttaatggagggcagccgcgccccggaggaggcaatctgggaagcgttgagtgtgatggggctgtatgatgggagggagcacagtgtctattggaagctcaggaagctgctcacccaagagtgggtgcaggagaactacctggagtaccgccaggcgcccggcagtgatcctgtgcgctacgagttcctgtggggtccaagggcccttgctgaaaccagctatgtgaaagtcctggagcatgtggtcagggtcaatgcaagagttcgcatttcctacccatccctgcatgaagaggctttgggagaggagaaaggagtttgagcaggagttgcagctagggccagtggggcaggttgtgggagggcctgggccagtgcacgttccagggccacatccaccactttccctgctctgttacatgaggcccattcttcactctgtgtttgaagagagcagtcacagttctcagtagtggggagcatgttgggtgtgagggaacacagtgtggaccatctctcagttcctgttctattgggcgatttggaggtttatctttgtttccttttggaattgttccaatgttccttctaatggatggtgtaatgaacttcaacattcattttatgtatgacagtagacagacttactgctttttatatagtttaggagtaagagtcttgcttttcatttatactgggaaacccatgttatttcttgaattcagacactacaagagcagaggattaaggtttttttagaaatgtgaaacaacatagcagtaaaatacatgagataaagacataaagaaattaaacaatagttaattcttgccttacctgtacctcttagtgtaccctatgtacctgaatttgcttggcttctttgagaatgaaattgaattaaatatgaataaataagtccccctgc

SEQ ID NO: 152540 - DNA, 1814 bp, Homo sapiens
  Payload ID: 10004
  Gene Symbol: MAGEA9
  Gene Name: melanoma antigen family A9
  Uniprot ID: P43362
  ENST ID: ENST00000243314
  CDS Start-End: 288-1235
gtgcgcactgggggtcagagagaagggagaggcctccttctgaggggcggcttgataccggtggaggagctccaggaagcaggcaggccttggtctgagacagtgtcctcaggtcgcagagcagaggagacccaggcagtgtcagcagtgaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttcgctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatcgaagttaatgaatgacagtagtcacacatattgctgtttatgttatttaggagtaagattcttgcttttgagtcacatggggaaatccctgttattttgtgaattgggacaagataacatagcagaggaattaataatttttttgaaacttgaacttagcagcaaaatagagctcataaagaaatagtgaaatgaaaatgtagttaattcttgccttatacctctttctctctcctgtaaaattaaaacatatacatgtatacctggatttgcttggcttctttgagcatgtaagagaaataaaaattgaaagaataa

SEQ ID NO: 152541 - DNA, 536 bp, Homo sapiens
  Payload ID: 10005
  Gene Symbol: MAGEA9B
  Gene Name: melanoma antigen family A9B
  ENST ID: ENST00000602102
  CDS Start-End: 195-536
actgggggtcagagagaagggagaggcctccttctgaggggcggcttgataccggtggaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgag

SEQ ID NO: 152542 - DNA, 594 bp, Homo sapiens
  Payload ID: 10005
  Gene Symbol: MAGEA9B
  Gene Name: melanoma antigen family A9B
  ENST ID: ENST00000594744
  CDS Start-End: 303-594
agagagtagcgggggcctcgctgtgaggggcgggtcgatatcggtggagggaagcgggcccaggctctgtgaggaggcaaggagctccaggaagcaggcaggccttggtctgagacagtgtcctcaggtcgcagagcagaggagacccaggcagtgtcagcagtgaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccag

SEQ ID NO: 152543 - DNA, 1807 bp, Homo sapiens
  Payload ID: 10005
  Gene Symbol: MAGEA9B
  Gene Name: melanoma antigen family A9B
  Uniprot ID: P43362
  ENST ID: ENST00000595065
  CDS Start-End: 281-1228
ctgggggtcagagagaagggagaggcctccttctgaggggcggcttgataccggtggaggagctccaggaagcaggcaggccttggtctgagacagtgtcctcaggtcgcagagcagaggagacccaggcagtgtcagcagtgaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttggctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatcgaagttaatgaatgacagtagtcacacatattgctgtttatgttatttaggagtaagattcttgcttttgagtcacatggggaaatccctgttattttgtgaattgggacaagataacatagcagaggaattaataatttttttgaaacttgaacttagcagcaaaatagagctcataaagaaatagtgaaatgaaaatgtagttaattcttgccttatacctctttctctctcctgtaaaattaaaatatatacatgtatacctggatttgcttggcttctttgagcatgtaagagaaataaaaattgaaagaataa

SEQ ID NO: 152544 - DNA, 891 bp, Homo sapiens
  Payload ID: 10005
  Gene Symbol: MAGEA9B
  Gene Name: melanoma antigen family A9B
  ENST ID: ENST00000593349
  CDS Start-End: 305-891
cagagagaagggagaggcctccttctgaggggcggcttgataccggtggaggtaagctggccgaggctctgtgaggagtcaaggagctccaggaagcaggcaggccttggtctgagacagtgtcctcaggtcgcagagcagaggagacccaggcagtgtcagcagtgaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcc

SEQ ID NO: 152545 - DNA, 1866 bp, Homo sapiens
  Payload ID: 10006
  Gene Symbol: MAGEB1
  Gene Name: melanoma antigen family B1
  Uniprot ID: P43366
  ENST ID: ENST00000378981
  CDS Start-End: 322-1365
cagtgttgcaactgggcctggcatgtttcagtgtggtgtccagcagtgtctcccactccttgtgaagtctgaggttgcaaaaggactgtgatcatatgaagatcatccaggagtacaactcgaaattctcagaaaacaggaccttgatgtgagaggagcaggttcaggtaaacaaagggcgaggacccgagcgagcttaaggagtggggtgcagcgtctggtcagcggagggtgaattctcaggactggtcgggagtcaaggtgccacatctcctgcctttctgctcactttcctgcctgttttgcctgaccacagccatcatgcctcggggtcagaagagtaagctccgtgctcgtgagaaacgccgcaaggcgcgagaggagacccagggtctcaaggttgctcacgccactgcagcagagaaagaggagtgcccctcctcctctcctgttttaggggatactcccacaagctcccctgctgctggcattccccagaagcctcagggagctccacccaccaccactgctgctgcagctgtgtcatgtaccgaatctgacgaaggtgccaaatgccaaggtgaggaaaatgcaagtttctcccaggccacaacatccactgagagctcagtcaaagatcctgtagcctgggaggcaggaatgctgatgcacttcattctacgtaagtataaaatgagagagcccattatgaaggcagatatgctgaaggttgttgatgaaaagtacaaggatcacttcactgagatcctcaatggagcctctcgccgcttggagctcgtctttggccttgatttgaaggaagacaaccctagtggccacacctacaccctcgtcagtaagctaaacctcaccaatgatggaaacctgagcaatgattgggactttcccaggaatgggcttctgatgcctctcctgggtgtgatcttcttaaagggcaactctgccaccgaggaagagatctggaaattcatgaatgtgttgggagcctatgatggagaggagcacttaatctatggggaaccccgtaagttcatcacccaagatctggtgcaggaaaaatatctgaagtacgagcaggtgcccaacagtgatcccccacgctatcaattcctatggggtccgagagcctatgctgaaaccaccaagatgaaagtcctcgagtttttggccaagatgaatggtgccactccccgtgacttcccatcccattatgaagaggctttgagagatgaggaagagagagcccaagtccgatccagtgttagagccaggcgtcgcactactgccacgacttttagagcgcgttctagagccccattcagcaggtcctcccaccccatgtgagaactcaggcagattgttcactttgtttttgtggcaagatgccaaccttttgaagtagtgagcagccaagatatggctagagagatcatcatatatatctcctttgtgttcctgttaaacattagtatctttcaagtgtttttcttttaatagaatgtttatttagagttgggatctatgtctatgagcgacatggatcacacatttattggtgctgccagctttaagcatatgagttttgatattctatatttttcaaatccttgaatcttttttgggttgaagaagaagaaagcatagctttagaatagagattttctcagaaatgtgtgaaagaacctcacacaacataattggagtcttaaaatagaggaagagtaagcaaagcatgtcaagtttttgttttctgcattcagttttgtttttgtaaaatccaaagatacatacctggttgtttttagccttttcaagaatgcagataaaataaatagtaataaatta

SEQ ID NO: 152546 - DNA, 1708 bp, Homo sapiens
  Payload ID: 10006
  Gene Symbol: MAGEB1
  Gene Name: melanoma antigen family B1
  Uniprot ID: P43366
  ENST ID: ENST00000397548
  CDS Start-End: 164-1207
ttccgctttgaaggcgaggaccccagcgagcgtaagggcgcagtgtccgcctggcggatttgggtcagcaggcggaagtcgtcccaggctgctagatactaaggtgccacatctcctgcctttctgctcactttcctgcctgttttgcctgaccacagccatcatgcctcggggtcagaagagtaagctccgtgctcgtgagaaacgccgcaaggcgcgagaggagacccagggtctcaaggttgctcacgccactgcagcagagaaagaggagtgcccctcctcctctcctgttttaggggatactcccacaagctcccctgctgctggcattccccagaagcctcagggagctccacccaccaccactgctgctgcagctgtgtcatgtaccgaatctgacgaaggtgccaaatgccaaggtgaggaaaatgcaagtttctcccaggccacaacatccactgagagctcagtcaaagatcctgtagcctgggaggcaggaatgctgatgcacttcattctacgtaagtataaaatgagagagcccattatgaaggcagatatgctgaaggttgttgatgaaaagtacaaggatcacttcactgagatcctcaatggagcctctcgccgcttggagctcgtctttggccttgatttgaaggaagacaaccctagtggccacacctacaccctcgtcagtaagctaaacctcaccaatgatggaaacctgagcaatgattgggactttcccaggaatgggcttctgatgcctctcctgggtgtgatcttcttaaagggcaactctgccaccgaggaagagatctggaaattcatgaatgtgttgggagcctatgatggagaggagcacttaatctatggggaaccccgtaagttcatcacccaagatctggtgcaggaaaaatatctgaagtacgagcaggtgcccaacagtgatcccccacgctatcaattcctatggggtccgagagcctatgctgaaaccaccaagatgaaagtcctcgagtttttggccaagatgaatggtgccactccccgtgacttcccatcccattatgaagaggctttgagagatgaggaagagagagcccaagtccgatccagtgttagagccaggcgtcgcactactgccacgacttttagagcgcgttctagagccccattcagcaggtcctcccaccccatgtgagaactcaggcagattgttcactttgtttttgtggcaagatgccaaccttttgaagtagtgagcagccaagatatggctagagagatcatcatatatatctcctttgtgttcctgttaaacattagtatctttcaagtgtttttcttttaatagaatgtttatttagagttgggatctatgtctatgagcgacatggatcacacatttattggtgctgccagctttaagcatatgagttttgatattctatatttttcaaatccttgaatcttttttgggttgaagaagaagaaagcatagctttagaatagagattttctcagaaatgtgtgaaagaacctcacacaacataattggagtcttaaaatagaggaagagtaagcaaagcatgtcaagtttttgttttctgcattcagttttgtttttgtaaaatccaaagatacatacctggttgtttttagccttttcaagaatgcagataaaataaatagtaataaatta

SEQ ID NO: 152547 - DNA, 1782 bp, Homo sapiens
  Payload ID: 10006
  Gene Symbol: MAGEB1
  Gene Name: melanoma antigen family B1
  Uniprot ID: P43366
  ENST ID: ENST00000397550
  CDS Start-End: 238-1281
agtgttgcaactgggcctggcatgtttcagtgtggtgtccagcagtgtctcccactccttgtgaagtctgaggttgcaaaaggactgtgatcatatgaagatcatccaggagtacaactcgaaattctcagaaaacaggaccttgatgtgagaggagcaggttcaggtaaacaaagggtgccacatctcctgcctttctgctcactttcctgcctgttttgcctgaccacagccatcatgcctcggggtcagaagagtaagctccgtgctcgtgagaaacgccgcaaggcgcgagaggagacccagggtctcaaggttgctcacgccactgcagcagagaaagaggagtgcccctcctcctctcctgttttaggggatactcccacaagctcccctgctgctggcattccccagaagcctcagggagctccacccaccaccactgctgctgcagctgtgtcatgtaccgaatctgacgaaggtgccaaatgccaaggtgaggaaaatgcaagtttctcccaggccacaacatccactgagagctcagtcaaagatcctgtagcctgggaggcaggaatgctgatgcacttcattctacgtaagtataaaatgagagagcccattatgaaggcagatatgctgaaggttgttgatgaaaagtacaaggatcacttcactgagatcctcaatggagcctctcgccgcttggagctcgtctttggccttgatttgaaggaagacaaccctagtggccacacctacaccctcgtcagtaagctaaacctcaccaatgatggaaacctgagcaatgattgggactttcccaggaatgggcttctgatgcctctcctgggtgtgatcttcttaaagggcaactctgccaccgaggaagagatctggaaattcatgaatgtgttgggagcctatgatggagaggagcacttaatctatggggaaccccgtaagttcatcacccaagatctggtgcaggaaaaatatctgaagtacgagcaggtgcccaacagtgatcccccacgctatcaattcctatggggtccgagagcctatgctgaaaccaccaagatgaaagtcctcgagtttttggccaagatgaatggtgccactccccgtgacttcccatcccattatgaagaggctttgagagatgaggaagagagagcccaagtccgatccagtgttagagccaggcgtcgcactactgccacgacttttagagcgcgttctagagccccattcagcaggtcctcccaccccatgtgagaactcaggcagattgttcactttgtttttgtggcaagatgccaaccttttgaagtagtgagcagccaagatatggctagagagatcatcatatatatctcctttgtgttcctgttaaacattagtatctttcaagtgtttttcttttaatagaatgtttatttagagttgggatctatgtctatgagcgacatggatcacacatttattggtgctgccagctttaagcatatgagttttgatattctatatttttcaaatccttgaatcttttttgggttgaagaagaagaaagcatagctttagaatagagattttctcagaaatgtgtgaaagaacctcacacaacataattggagtcttaaaatagaggaagagtaagcaaagcatgtcaagtttttgttttctgcattcagttttgtttttgtaaaatccaaagatacatacctggttgtttttagccttttcaagaatgcagataaaataaatagtaataaatta

SEQ ID NO: 152548 - DNA, 1953 bp, Homo sapiens
  Payload ID: 10007
  Gene Symbol: MAGEB10
  Gene Name: melanoma antigen family B10
  Uniprot ID: Q96LZ2
  ENST ID: ENST00000356790
  CDS Start-End: 246-1289
gattggtatctggtcagcagagaaaggcatccaggccccgccaggagagacggtgcctcgctctgttgcccagactggagtgcagtggtgtgatcataactcagtatagcctagaactcctgagctcaagcaatcctcccacctcagcctttcaagcagctaggagtacagttgggagccactgtacctggttactgtcacgggatcacctgcctttttggctgctgcacctgaacagagtcatcatgcctcgaggtcagaagagtaaactccgtgccagggaaaaacgccgtcaggcccgaggagggctggaagatttgatagatgctctggacattttagaagaggaggaagaatctcccccctctgcctctgcttgtttgaaggatgttttccagagttcacttgatggggcatccaacaatccccatggacttcgggaagcccaatccaccagcacatctgctacagctgcttcacacacaagacatcccgaaggagtcaacgaccaaatggaagaaaggccaatatgcacacaagatctagaagccactgatagctttcccagaggccctgtagatgagaaagtaattatattggtgcattacttgctgtacaagtaccaaatgaaagagcccattacaaaggcagatatgctgagaaatgtaacccaaatgtccaagagccagttccctgtaatcctgagcagagcttctgagcacctggagctgatctttggtcttgacctgaaggaagtggagcctaataagcacatctatgtccttgtcaacaaactagatctaggctgtgatgcaaagctgagtgatgaaacaggcgtgcccaagactggcctgctgatgactgtcctgggtattatcttcacaaatggcaattgtgtcgctgaggaggaagtctggaaagtgtttaacacgatggggttatatgacggaattgagcacttcatgtttggggagcccaggaagctccttaccaaagatttggtgaaagaaaattacctggagtaccagcaagtgcccaacagtgatcctccacgctatcaattcctatggggcccaagagcccatgctgaaaccagcaagatgaaagttcttgagtttttggccaaggtaaatgatacagctcccagtgaattctcaaactggtatacagaggctttacaagatgaggaagagagagccagagccagagttgcagccaaggctcgcgttagtgccacagccggtgcacgttccaaggttaagtccagcaagtcctcccaactgcagtaaagtctgagggagattcttcatttgtgtttgaaaagaaatgcacattctgagctgtgggaggtcagggtgggactggagacaacacagtgaataatatgtttgtgttaatgttctatgtgatggcttggaatttttgaagatgttgttcctttaatagatggttaaagtagcttcactatctaagtttatgaatgacattgctcaaatttttctgtatgtgagattaagagtaagcgatttattgctttataagtctaattgggaaactctccatttatttagtgatcgaaacacgatagcatggtagtaaattaggcatttcctaattcaatgtgaaataatttaggagtgtaataaatgggatcaagaaatagagcaaagagggtcgggtgcggtggctcacacctgtaatcctagcactttgggaggccgaggcaggcggatcatgaggtcaggagatcaagaccatcttggctaacacagtgaaaccccgtctctactaaaaatacaaaaaattagccaggcgtggtggcgggttcctgtagtcctagctgctcaggaggctgaggcaggagaatggcgtaaacccgggaggcggagcttgcagtgagccaagatcacacgactgcattctagcctgggtgacagagcgagactctgtctc

SEQ ID NO: 152549 - DNA, 1389 bp, Homo sapiens
  Payload ID: 10007
  Gene Symbol: MAGEB10
  Gene Name: melanoma antigen family B10
  Uniprot ID: Q96LZ2
  ENST ID: ENST00000614159
  CDS Start-End: 50-1093
gtcacgggatcacctgcctttttggctgctgcacctgaacagagtcatcatgcctcgaggtcagaagagtaaactccgtgccagggaaaaacgccgtcaggcccgaggagggctggaagatttgatagatgctctggacattttagaagaggaggaagaatctcccccctctgcctctgcttgtttgaaggatgttttccagagttcacttgatggggcatccaacaatccccatggacttcgggaagcccaatccaccagcacatctgctacagctgcttcacacacaagacatcccgaaggagtcaacgaccaaatggaagaaaggccaatatgcacacaagatctagaagccactgatagctttcccagaggccctgtagatgagaaagtaattatattggtgcattacttgctgtacaagtaccaaatgaaagagcccattacaaaggcagatatgctgagaaatgtaacccaaatgtccaagagccagttccctgtaatcctgagcagagcttctgagcacctggagctgatctttggtcttgacctgaaggaagtggagcctaataagcacatctatgtccttgtcaacaaactagatctaggctgtgatgcaaagctgagtgatgaaacaggcgtgcccaagactggcctgctgatgactgtcctgggtattatcttcacaaatggcaattgtgtcgctgaggaggaagtctggaaagtgtttaacacgatggggttatatgacggaattgagcacttcatgtttggggagcccaggaagctccttaccaaagatttggtgaaagaaaattacctggagtaccagcaagtgcccaacagtgatcctccacgctatcaattcctatggggcccaagagcccatgctgaaaccagcaagatgaaagttcttgagtttttggccaaggtaaatgatacagctcccagtgaattctcaaactggtatacagaggctttacaagatgaggaagagagagccagagccagagttgcagccaaggctcgcgttagtgccacagccggtgcacgttccaaggttaagtccagcaagtcctcccaactgcagtaaagtctgagggagattcttcatttgtgtttgaaaagaaatgcacattctgagctgtgggaggtcagggtgggactggagacaacacagtgaataatatgtttgtgttaatgttctatgtgatggcttggaatttttgaagatgttgttcctttaatagatggttaaagtagcttcactatctaagtttatgaatgacattgctcaaatttttctgtatgtgagattaagagtaagcgatttattgctttataagtctaattgggaaactctccatttatttagtgatcgaaacacga

SEQ ID NO: 152550 - DNA, 1667 bp, Homo sapiens
  Payload ID: 10008
  Gene Symbol: MAGEB16
  Gene Name: melanoma antigen family B16
  Uniprot ID: A2A368
  ENST ID: ENST00000399985
  CDS Start-End: 129-1103
agtctgatataggcagtgtcgtgtcggcagaggaaggcatctcaggccctgcaggagtccaggcagtgattcttcattgcctgccctcctgtccacactcctgcctactgccacccacaagggtcatcatgtctcaggatcaggagagtccacgatgcacacatgatcagcaccttcagaccttcagtgagacccagagcctggaggttgcacaggtctccaaggctctggagaagaccctcctctcctcctcccatcctctagtgcctggcaaactgaaggaagctcctgctgctaaggcagagagtcctcttgaggttcctcagagtttctgctcctcttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcatgctgcacaagtgtcagatgaaaaagccaataacaaaggcagatatgttgaagattatcatcaaagatgatgagagccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattgtcctgggtgtgatcttcatgaagggcaaccgtgccactgaagaggaagtctgggaagtgctgaatttgacgggagtatattctgggaagaagcacttcatctttggagagcccagaatgctcatcaccaaagattttgtgaaggagaagtacctggagtaccagcaggtggccaacagtgatcctgcacgatatgaattcctgtggggcccaagagccaaagctgaaaccagcaagatgaaagtcctggagtttgtggccaaagttcatgggtcttacccacattctttcccatctcagtatgcggaagctctgaaagaggaagaagagagagctagagccagaatttgagtcagggctgactccatttccacagccactgtgagttccagtgctatgtctggtagcttctcccatacctagtgaagacaaggatagatgttttatgtaacatttgcagaaggcagttagtgttcaaggatgcaggtccagggtggggctggaggaaaaatagtatatatcatctatatccctattttgtatgtgtaacttgacagtttattcttttattttttaatggctatattattcagatgatgtttcttttaatagaagtttaggtagtttccagatctcttaagttttgaataatattggtcatccatttaatgtttttcatgaggtttagtggcatatgttttgctgattttgtaaaacagattgggaaaccatctatattgtgttctgatataggatgacatgacattactaagaactctgcttttaaatatccgtttaatgttttgcatgcagtttagtagcaaaggttttgttaattttgtaaaacagattagaaaaccatccatctatattgtgttctagtatagcatgacatgacattgctaagaactttgc

SEQ ID NO: 152551 - DNA, 1736 bp, Homo sapiens
  Payload ID: 10008
  Gene Symbol: MAGEB16
  Gene Name: melanoma antigen family B16
  Uniprot ID: A2A368
  ENST ID: ENST00000399987
  CDS Start-End: 198-1172
tgtgacgaccttatctgaggaaggtgcaccctagtcatcagaggaacgagtcgctgcaggcactgtcaggtgtcgaggtgactcaggaggatgaggtattcttgaaggtggagagtggcattagtatactggcagtgattcttcattgcctgccctcctgtccacactcctgcctactgccacccacaagggtcatcatgtctcaggatcaggagagtccacgatgcacacatgatcagcaccttcagaccttcagtgagacccagagcctggaggttgcacaggtctccaaggctctggagaagaccctcctctcctcctcccatcctctagtgcctggcaaactgaaggaagctcctgctgctaaggcagagagtcctcttgaggttcctcagagtttctgctcctcttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcatgctgcacaagtgtcagatgaaaaagccaataacaaaggcagatatgttgaagattatcatcaaagatgatgagagccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattgtcctgggtgtgatcttcatgaagggcaaccgtgccactgaagaggaagtctgggaagtgctgaatttgacgggagtatattctgggaagaagcacttcatctttggagagcccagaatgctcatcaccaaagattttgtgaaggagaagtacctggagtaccagcaggtggccaacagtgatcctgcacgatatgaattcctgtggggcccaagagccaaagctgaaaccagcaagatgaaagtcctggagtttgtggccaaagttcatgggtcttacccacattctttcccatctcagtatgcggaagctctgaaagaggaagaagagagagctagagccagaatttgagtcagggctgactccatttccacagccactgtgagttccagtgctatgtctggtagcttctcccatacctagtgaagacaaggatagatgttttatgtaacatttgcagaaggcagttagtgttcaaggatgcaggtccagggtggggctggaggaaaaatagtatatatcatctatatccctattttgtatgtgtaacttgacagtttattcttttattttttaatggctatattattcagatgatgtttcttttaatagaagtttaggtagtttccagatctcttaagttttgaataatattggtcatccatttaatgtttttcatgaggtttagtggcatatgttttgctgattttgtaaaacagattgggaaaccatctatattgtgttctgatataggatgacatgacattactaagaactctgcttttaaatatccgtttaatgttttgcatgcagtttagtagcaaaggttttgttaattttgtaaaacagattagaaaaccatccatctatattgtgttctagtatagcatgacatgacattgctaagaactttgc

SEQ ID NO: 152552 - DNA, 1682 bp, Homo sapiens
  Payload ID: 10008
  Gene Symbol: MAGEB16
  Gene Name: melanoma antigen family B16
  Uniprot ID: A2A368
  ENST ID: ENST00000399988
  CDS Start-End: 144-1118
tgtgacgaccttatctgaggaaggtgcaccctagtcatcagaggaacgagtcgctgcaggcactgtcaggtgtcgaggcagtgattcttcattgcctgccctcctgtccacactcctgcctactgccacccacaagggtcatcatgtctcaggatcaggagagtccacgatgcacacatgatcagcaccttcagaccttcagtgagacccagagcctggaggttgcacaggtctccaaggctctggagaagaccctcctctcctcctcccatcctctagtgcctggcaaactgaaggaagctcctgctgctaaggcagagagtcctcttgaggttcctcagagtttctgctcctcttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcatgctgcacaagtgtcagatgaaaaagccaataacaaaggcagatatgttgaagattatcatcaaagatgatgagagccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattgtcctgggtgtgatcttcatgaagggcaaccgtgccactgaagaggaagtctgggaagtgctgaatttgacgggagtatattctgggaagaagcacttcatctttggagagcccagaatgctcatcaccaaagattttgtgaaggagaagtacctggagtaccagcaggtggccaacagtgatcctgcacgatatgaattcctgtggggcccaagagccaaagctgaaaccagcaagatgaaagtcctggagtttgtggccaaagttcatgggtcttacccacattctttcccatctcagtatgcggaagctctgaaagaggaagaagagagagctagagccagaatttgagtcagggctgactccatttccacagccactgtgagttccagtgctatgtctggtagcttctcccatacctagtgaagacaaggatagatgttttatgtaacatttgcagaaggcagttagtgttcaaggatgcaggtccagggtggggctggaggaaaaatagtatatatcatctatatccctattttgtatgtgtaacttgacagtttattcttttattttttaatggctatattattcagatgatgtttcttttaatagaagtttaggtagtttccagatctcttaagttttgaataatattggtcatccatttaatgtttttcatgaggtttagtggcatatgttttgctgattttgtaaaacagattgggaaaccatctatattgtgttctgatataggatgacatgacattactaagaactctgcttttaaatatccgtttaatgttttgcatgcagtttagtagcaaaggttttgttaattttgtaaaacagattagaaaaccatccatctatattgtgttctagtatagcatgacatgacattgctaagaactttgc

SEQ ID NO: 152553 - DNA, 1818 bp, Homo sapiens
  Payload ID: 10008
  Gene Symbol: MAGEB16
  Gene Name: melanoma antigen family B16
  Uniprot ID: A2A368
  ENST ID: ENST00000399989
  CDS Start-End: 280-1254
tgtgacgaccttatctgaggaaggtgcaccctagtcatcagaggaacgagtcgctgcaggcactgtcaggtgtcgaggtaaaactctgagactgagggaaatagagcgccctgcagataagagccccaggccctgcagtcaactctgggaggccgtgggctggactttcaggctgaacccaccccacatttctccctcgggaatctgattaaggcagtgattcttcattgcctgccctcctgtccacactcctgcctactgccacccacaagggtcatcatgtctcaggatcaggagagtccacgatgcacacatgatcagcaccttcagaccttcagtgagacccagagcctggaggttgcacaggtctccaaggctctggagaagaccctcctctcctcctcccatcctctagtgcctggcaaactgaaggaagctcctgctgctaaggcagagagtcctcttgaggttcctcagagtttctgctcctcttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcatgctgcacaagtgtcagatgaaaaagccaataacaaaggcagatatgttgaagattatcatcaaagatgatgagagccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattgtcctgggtgtgatcttcatgaagggcaaccgtgccactgaagaggaagtctgggaagtgctgaatttgacgggagtatattctgggaagaagcacttcatctttggagagcccagaatgctcatcaccaaagattttgtgaaggagaagtacctggagtaccagcaggtggccaacagtgatcctgcacgatatgaattcctgtggggcccaagagccaaagctgaaaccagcaagatgaaagtcctggagtttgtggccaaagttcatgggtcttacccacattctttcccatctcagtatgcggaagctctgaaagaggaagaagagagagctagagccagaatttgagtcagggctgactccatttccacagccactgtgagttccagtgctatgtctggtagcttctcccatacctagtgaagacaaggatagatgttttatgtaacatttgcagaaggcagttagtgttcaaggatgcaggtccagggtggggctggaggaaaaatagtatatatcatctatatccctattttgtatgtgtaacttgacagtttattcttttattttttaatggctatattattcagatgatgtttcttttaatagaagtttaggtagtttccagatctcttaagttttgaataatattggtcatccatttaatgtttttcatgaggtttagtggcatatgttttgctgattttgtaaaacagattgggaaaccatctatattgtgttctgatataggatgacatgacattactaagaactctgcttttaaatatccgtttaatgttttgcatgcagtttagtagcaaaggttttgttaattttgtaaaacagattagaaaaccatccatctatattgtgttctagtatagcatgacatgacattgctaagaactttgc

SEQ ID NO: 152554 - DNA, 1734 bp, Homo sapiens
  Payload ID: 10008
  Gene Symbol: MAGEB16
  Gene Name: melanoma antigen family B16
  ENST ID: ENST00000399992
  CDS Start-End: 100-1170
tgtgacgaccttatctgaggaaggtgcaccctagtcatcagaggaacgagtcgctgcaggcactgtcaggtgtcgaggagtggcattagctatcagaagatggggactgaagcccaaccagtagtcaaagcagtgattcttcattgcctgccctcctgtccacactcctgcctactgccacccacaagggtcatcatgtctcaggatcaggagagtccacgatgcacacatgatcagcaccttcagaccttcagtgagacccagagcctggaggttgcacaggtctccaaggctctggagaagaccctcctctcctcctcccatcctctagtgcctggcaaactgaaggaagctcctgctgctaaggcagagagtcctcttgaggttcctcagagtttctgctcctcttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcatgctgcacaagtgtcagatgaaaaagccaataacaaaggcagatatgttgaagattatcatcaaagatgatgagagccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattgtcctgggtgtgatcttcatgaagggcaaccgtgccactgaagaggaagtctgggaagtgctgaatttgacgggagtatattctgggaagaagcacttcatctttggagagcccagaatgctcatcaccaaagattttgtgaaggagaagtacctggagtaccagcaggtggccaacagtgatcctgcacgatatgaattcctgtggggcccaagagccaaagctgaaaccagcaagatgaaagtcctggagtttgtggccaaagttcatgggtcttacccacattctttcccatctcagtatgcggaagctctgaaagaggaagaagagagagctagagccagaatttgagtcagggctgactccatttccacagccactgtgagttccagtgctatgtctggtagcttctcccatacctagtgaagacaaggatagatgttttatgtaacatttgcagaaggcagttagtgttcaaggatgcaggtccagggtggggctggaggaaaaatagtatatatcatctatatccctattttgtatgtgtaacttgacagtttattcttttattttttaatggctatattattcagatgatgtttcttttaatagaagtttaggtagtttccagatctcttaagttttgaataatattggtcatccatttaatgtttttcatgaggtttagtggcatatgttttgctgattttgtaaaacagattgggaaaccatctatattgtgttctgatataggatgacatgacattactaagaactctgcttttaaatatccgtttaatgttttgcatgcagtttagtagcaaaggttttgttaattttgtaaaacagattagaaaaccatccatctatattgtgttctagtatagcatgacatgacattgctaagaactttgc

SEQ ID NO: 152555 - DNA, 1379 bp, Homo sapiens
  Payload ID: 10009
  Gene Symbol: MAGEB17
  Gene Name: melanoma antigen family B17
  Uniprot ID: A8MXT2
  ENST ID: ENST00000400003
  CDS Start-End: 298-1308
ggaagtgaggatcttcgtctgagggacgccacctcaggctaccagaaccccaagactggttgggtatcaagggtgttgcctgtagtgagctgaggatggagtcccaggactggtcaagtagcaaggtgaagatcctgagccctcagtagacagggctgcacggagcgtttcagcagagggctttggttgcaagactggctgccccaggtcagcggagaaaggagtcccaggctctgtggggagtgaaggtgcccacctcctgcaccctcttgcctgctgcccctaagcacagtcatcatgcctcgcggtcaggcgagtaagcgccgtgcccgtgagaaacgccgccaggctcgaggtgaagaccaatgtctcgggggtgctcaagccaccgcagcagagaaggaaaagctgccatcctcctcctctcctgcatgccagagtcctccccagagcttccccaatgcaggcattcctcaggagtcccagagagccagctaccccagctctcctgcttcagctgtttcactcacaagttctgatgaaggtgccaagggccaaaagggggaaagtcccaactccttccatggcccgtcctcctctgagagcacaggaagagatcttctgaacacgaagacgggcgaattggtgcagttcctcctcaacaagtatataaggaaagagcccattacgagggaagccatgctgaaggttatcaacagaaagtacaagcagcacttccctgagatcctccggagaagcactgagaacgtagaggtggtctttggcctctacctgaaggaaatggaccccagccgtcagtcctatgtgcttgttggcaagctggactttcccaatcaaggaagcttgagcgatggcgggggctttcccctgagcgggctcctgatggttctcctgagcaccatcttcatgcatggcaaccgtgccactgaggaagagatgtgggaatgcctgaatgcattggggatgtataagggtaggaagcacttcatctatggggagccccaggagcttgtcaccaaagatttggtgcgagaggggtacctggagtaccagcaggtgcccagcagcgatcctccacgctacgagttcctgtggggtcccagggcccgtgctgaaaccagcaaaatgaaagtcctggagtttgtggccaagctcaatgataccgttgccagtacctacaagtcccggtatgaggaggctctgagagaggaggaagagcaagccagagccagagcggtagccagggatagcgccagggccagggctagcaggtcctttcagccctagtgaagtctcaggcaatcctcactaagagattgaaaagcctgtccaccatctcagtatttgggggtgaggtg

SEQ ID NO: 152556 - DNA, 1434 bp, Homo sapiens
  Payload ID: 10009
  Gene Symbol: MAGEB17
  Gene Name: melanoma antigen family B17
  Uniprot ID: A8MXT2
  ENST ID: ENST00000400004
  CDS Start-End: 353-1363
gatgctctaacgagggtagtgactctgtctaaaggcaaaagcacagttcagctgagggaggagaactggacactcattggagtcccggagaggacactgagtacactggagaggacttctatgcaaaaagggggcccgagcagagccccgccccgctttcagccctgggagacccagcagggacttgattggatgtggctcactccgacatccgcccgcctgggaagctgccggaagtgaggatcttcgtctgagggacgccacctcaggctaccagaaccccaagactggttgggtatcaaggtgcccacctcctgcaccctcttgcctgctgcccctaagcacagtcatcatgcctcgcggtcaggcgagtaagcgccgtgcccgtgagaaacgccgccaggctcgaggtgaagaccaatgtctcgggggtgctcaagccaccgcagcagagaaggaaaagctgccatcctcctcctctcctgcatgccagagtcctccccagagcttccccaatgcaggcattcctcaggagtcccagagagccagctaccccagctctcctgcttcagctgtttcactcacaagttctgatgaaggtgccaagggccaaaagggggaaagtcccaactccttccatggcccgtcctcctctgagagcacaggaagagatcttctgaacacgaagacgggcgaattggtgcagttcctcctcaacaagtatataaggaaagagcccattacgagggaagccatgctgaaggttatcaacagaaagtacaagcagcacttccctgagatcctccggagaagcactgagaacgtagaggtggtctttggcctctacctgaaggaaatggaccccagccgtcagtcctatgtgcttgttggcaagctggactttcccaatcaaggaagcttgagcgatggcgggggctttcccctgagcgggctcctgatggttctcctgagcaccatcttcatgcatggcaaccgtgccactgaggaagagatgtgggaatgcctgaatgcattggggatgtataagggtaggaagcacttcatctatggggagccccaggagcttgtcaccaaagatttggtgcgagaggggtacctggagtaccagcaggtgcccagcagcgatcctccacgctacgagttcctgtggggtcccagggcccgtgctgaaaccagcaaaatgaaagtcctggagtttgtggccaagctcaatgataccgttgccagtacctacaagtcccggtatgaggaggctctgagagaggaggaagagcaagccagagccagagcggtagccagggatagcgccagggccagggctagcaggtcctttcagccctagtgaagtctcaggcaatcctcactaagagattgaaaagcctgtccaccatctcagtatttgggggtgaggtg

SEQ ID NO: 152557 - DNA, 1811 bp, Homo sapiens
  Payload ID: 10010
  Gene Symbol: MAGEB18
  Gene Name: melanoma antigen family B18
  Uniprot ID: Q96M61
  ENST ID: ENST00000325250
  CDS Start-End: 188-1219
aaagtgggcgtggccggacatgtttctcttgacctatcttccacatcatcaagctgttacgggcgaaaccttggtctgaaacatgcggccagagaaataaatctcaggatccggcaggtgtcaaaggtgccctcttcatcaattcaactgcctgcactattgtctgtagtccctgacaagagtaattatgcctcgaggtcagaagagtaagctccgtgcccgtgagaaacgccaccaggctcgttgtgagaatcaggatctgggagctacgcaggccactgtggcagaaggagagtcaccctcccctgcctatcttctctttggtgacagaccccagaatttgcctgctgctgagacacctagcatccctgaagcgcttcagggagccccatccaccaccaatgctattgcacctgtttcatgcagttcaaatgaaggtgccagcagccaagatgagaaaagtctaggttcctcaagggaagctgagggctggaaagaagatcctttaaacaagaaagtagtgtcgctggtgcatttcttgcttcagaagtatgaaacgaaagagccaattacaaagggagatatgataaagtttgttatcaggaaggataagtgtcacttcaatgagatcctcaagagagcctctgagcacatggagctggcacttggtgttgatttgaaggaagtggatcccatcaggcactactatgcctttttcagcaaattagacctcacctatgatgaaacaaccagtgatgaagaaaaaattcccaagactggcctcctgatgattgcactgggtgtgatctttctgaatggcaaccgtgccccagaagaggcagtctgggaaattatgaatatgatgggtgtatatgccgataggaagcacttcctctatggggatcccaggaaggtcatgaccaaagatttggtgcagctaaagtacctggagtaccagcaagtgcccaacagtgatcctccacgctatgaattcctgtggggtccaagagctcacgctgaaactagcaagatgaaagtcctggagtttgtagccaagatacatgataccgtccctagtgccttcccatcctgctatgaagaggctttgagggatgaggaacagagaacccaagccagagctgcagccagggctcatactgctgccatggcaaatgcacgttccagaaccacgtctagcagcttctcccatgctaagtgaaatctgaggcttgttcttcactttttggtcgaaaaggttacatttcaaatgttcaagtctgaagattgttttctttgtggaagagaagagcagtcaacattctaagtagtgaatggccagagtgcgtctggagggaacacagcatatatcattttgtgttaatagtctatagtaactcggagttgtatctttttctttcttttttttttggtgttatatttcaaatgttgttgcttataatagaagttttagataacttcagaatctatatttattaatgactttggttacacacgtattgctatttaagagtaggagttttattgttctgtaaaacaaattgggaaaccttctttcatatttaatgagccagaacaaggaaacacagtattggaataggtatttccttaaaaaatgtgagatgatttagcagtaaaattttggagatcaaaacataggtgagaaaaagtaaacttttcagttcttggttttctttttccattttagtctgttatataaaaataaaagtcatacctggattggcttagcttactgaagaaggtaggaagaaataaaatgtttatgaaccagc

SEQ ID NO: 152558 - DNA, 1610 bp, Homo sapiens
  Payload ID: 10011
  Gene Symbol: MAGEB2
  Gene Name: melanoma antigen family B2
  Uniprot ID: O15479
  ENST ID: ENST00000378988
  CDS Start-End: 102-1061
ctgacttccgctttggaggcgaggacccgagcgagtgtagggggtgcggcgtctggtcagccaggggtgaattctcaggactggtcggcagtcaagccatcatgcctcgtggtcagaagagtaagctccgtgcccgtgagaaacgccgcaaggcccgagatgagacccggggtctcaatgttcctcaggtcactgaagcagaggaagaagaggccccctgctgttcctcttctgtttctgggggtgctgcttcaagctctcctgctgctggcattccccaggagcctcagagagccccaaccactgccgctgctgcggctgcgggtgtttcatccacaaaatctaaaaaaggtgccaagagccaccaaggtgagaaaaatgcaagttcctcccaggcctcaacatccactaagagcccaagcgaagatcctctaaccaggaagtcagggtcgttggtgcagttcctgttgtacaagtataaaataaaaaagtccgttacaaagggagaaatgctgaaaattgttggcaaaaggttcagggagcacttccctgagatcctcaagaaagcctctgagggcctcagtgttgtctttggccttgagctgaataaagtcaaccccaacggccacacttacaccttcatcgacaaggtagacctcactgatgaggaatccctgctcagttcctgggactttcccaggagaaagcttctgatgcctctcctgggtgtgatcttcttaaatggcaactcagctactgaggaagagatctgggaattcctgaatatgttgggagtctatgatggagaggagcactcagtctttggggaaccctggaagctcatcaccaaagatctggtgcaggaaaaatatctggagtacaagcaggtgcccagcagtgatcccccacgctttcaattcctgtggggtccgagagcctatgctgaaaccagcaagatgaaagtcctggagtttttggccaaggtaaatggtaccaccccctgtgccttcccaacccattacgaagaagctttgaaagatgaagagaaagccggagtctgagccagagttgtagccaggccttgcactactgccatagccaatcaatctcccaaagccaagtttacctgctgttctcacccccaatgaggtcttaggcagattctttactttgtaattcaaaaggcctgttaacctttgttcttgttatgcatgaataacttgttgactttttttttttctctttttcaactagtgtttcaacaggtttatttagattcagaatgtaaatttacaaatgatatagatcaccctgttattgctgtttttcagggacagtagaaagtgttttgttttttgagtgaaacaacttattaataaaaatccttaaatcacttttgtaatccaggacaagaaaatgtggcattagagtagaaatatctttggaaatgtgaaagaccccatagtgaaatatttgggatcagaagccagaggtgtaaaagtggtcaattcttggtttacttcatttaatctttcttttcataaagatacatacctggatttgtttatgttattcaagaatgtgtgagaaattaaaccatagttagttaa

SEQ ID NO: 152559 - DNA, 2305 bp, Homo sapiens
  Payload ID: 10012
  Gene Symbol: MAGEB3
  Gene Name: melanoma antigen family B3
  Uniprot ID: O15480
  ENST ID: ENST00000361644
  CDS Start-End: 738-1778
ataacggggcaatctacccaaacctcttctcagcctagaatgccccaggcagtgcagtcagactgagcatcctctcttttacccttcagagttctcagtgaagtgagagttttgacctaaggtgacctcagttaactagagggaggatccagggtctggcagatatcagggaggaccttgaatgaagaacaggaggagccagaacagtgatgtcccatagaaacccgactccgctgtctgccctcacaggacccaaacatccctggcctaatgtggctcatcaaaacttcagcctagatctcggaggaccttgatctgagcaggattcatggcatggaatgtggagtcccaggactggccagcagcgaagtgaggttcttgagcagggctctggctcacgcttgtaatcccaacattttgggaggacgaagccagcctcatcgcttaagcacaggagttcgaggactgggaggtggaggttgtggcagggctgtggctcacgcttgtaatcccaacattttgggcggaggaagccagcctcatcgcttaagcacaggagttcgcggactgggaggcagggctctggctcacgcttgtaatcccaacattttgggaggacgaagccagcctcatcgcttaagcacaggagttcgaggactgggaggtggaggttgtggtgcctgtatcacctgcccttctgctgacactcctgcctgctgttcctgactacagccatcatgcctcggggtcagaagagtacgctccatgcacgtgagaaacgccagcagacccggggtcagacccaggatcaccagggtgctcagatcactgcaactaacaagaaaaaagtatccttttcatcccctcttattttgggggctactatccagaaaaagtctgctggtaggtcacgtagtgctctcaagaagcctcagagagcactatccaccactacatctgtagatgtttcttacaaaaagtcatacaagggagccaacagcaaaattgagaaaaagcaaagcttctctcagggtctatcctccactgtgcagtctcgcacagaccctctaatcatgaagacaaatatgttggtgcagttcctgatggaaatgtacaagatgaaaaagcccattatgaaagcagatatgctaaaaattgtccaaaaaagccataagaattgcttccctgagatccttaaaaaagcttctttcaacatggaggtggtatttggtgttgatttaaagaaagttgattctaccaaggactcctatgtccttgtcagcaaaatggatctccccaacaatgggacagtgactcgtgggaggggatttcccaagacaggtctcctgctgaatctcctgggcgtgatcttcatgaagggcaactgtgccactgaggagaagatctgggaattcctgaataagatgagaatatatgatgggaagaaacacttcatatttggggagcccagaaagctcatcacccaagatttggtgaagcttaaatacctggagtaccgacaagtgcccaacagtaatcctgcacgctatgaattcctgtggggtccaagagcccatgctgaaaccagcaagatgaaggtcctggagttttgggccaaggtcaataaaactgtccccagtgcgttccagttctggtatgaagaggctttgagagatgaggaagaaagagtccaagctgcagctatgctcaatgatggcagtagtgccatgggcagaaagtgttccaaggccaaggctagcagctcttcccacgcctagtgaagttgaagcaaattttgcattttgtggttaaagagggcagtcactgttccaaggagtgaaggactgggtgttactggagggaacacactgtataataccttttgtttctgttctaaatggataatttgaagttttatctgtattttggggcatatttttcaaatgttccttttatttaacattgtaatctaagtttaggattgatactggtcacatttgttgtttaagagtaaaaattttgctgttttgtaaaacagattgagaaaaattcgatcttatttagtgatctgttgcaagataacttggaattagaataagcatttccttgaaaatgtttaaaaaaaaaaagtcagcagtaaaatgtatggcattaagaaatagagaaagagtgtaagatggtcaatatttggtttcctaaatgcttttactctgtgctttaagaaaatgaaagataaataaccatatatgtctggcttacttaagaatgtagaattaaatcataataaattagacctcatgctgac

SEQ ID NO: 152560 - DNA, 1129 bp, Homo sapiens
  Payload ID: 10012
  Gene Symbol: MAGEB3
  Gene Name: melanoma antigen family B3
  Uniprot ID: O15480
  ENST ID: ENST00000620842
  CDS Start-End: 32-1072
ctcctgcctgctgttcctgactacagccatcatgcctcggggtcagaagagtacgctccatgcacgtgagaaacgccagcagacccggggtcagacccaggatcaccagggtgctcagatcactgcaactaacaagaaaaaagtatccttttcatcccctcttattttgggggctactatccagaaaaagtctgctggtaggtcacgtagtgctctcaagaagcctcagagagcactatccaccactacatctgtagatgtttcttacaaaaagtcatacaagggagccaacagcaaaattgagaaaaagcaaagcttctctcagggtctatcctccactgtgcagtctcgcacagaccctctaatcatgaagacaaatatgttggtgcagttcctgatggaaatgtacaagatgaaaaagcccattatgaaagcagatatgctaaaaattgtccaaaaaagccataagaattgcttccctgagatccttaaaaaagcttctttcaacatggaggtggtatttggtgttgatttaaagaaagttgattctaccaaggactcctatgtccttgtcagcaaaatggatctccccaacaatgggacagtgactcgtgggaggggatttcccaagacaggtctcctgctgaatctcctgggcgtgatcttcatgaagggcaactgtgccactgaggagaagatctgggaattcctgaataagatgagaatatatgatgggaagaaacacttcatatttggggagcccagaaagctcatcacccaagatttggtgaagcttaaatacctggagtaccgacaagtgcccaacagtaatcctgcacgctatgaattcctgtggggtccaagagcccatgctgaaaccagcaagatgaaggtcctggagttttgggccaaggtcaataaaactgtccccagtgcgttccagttctggtatgaagaggctttgagagatgaggaagaaagagtccaagctgcagctatgctcaatgatggcagtagtgccatgggcagaaagtgttccaaggccaaggctagcagctcttcccacgcctagtgaagttgaagcaaattttgcattttgtggttaaagagggcagtcactgttccaagg

SEQ ID NO: 152561 - DNA, 2142 bp, Homo sapiens
  Payload ID: 10013
  Gene Symbol: MAGEB4
  Gene Name: melanoma antigen family B4
  Uniprot ID: O15481
  ENST ID: ENST00000378982
  CDS Start-End: 85-1125
aggatttcatttgctcttctccaggaaccacatcacctgcccttctgcctacactcctgcctgctgtgcctaaccacagccatcatgcctcggggtcagaagagtaagctccgtgcccgtgagaaacgccagcggacccgtggtcagacccaggatctcaaggttggtcagcctactgcagcagagaaagaagagtctccttcctcttcctcatctgttttgagggatactgcctccagctcccttgcttttggcattccccaggagcctcagagagagccacccaccacctctgctgctgcagctatgtcatgcactggatctgataaaggcgacgagagccaagatgaggaaaatgcaagttcctcccaggcctcaacatccactgagagatcactcaaagattctctaaccaggaagacgaagatgttagtgcagttcctgctgtacaagtataaaatgaaagagcccactacaaaggcagaaatgctgaagatcatcagcaaaaagtacaaggagcacttccctgagatcttcaggaaagtctctcagcgcacggagctggtctttggccttgccttgaaggaggtcaaccccaccactcactcctacatcctcgtcagcatgctaggccccaacgatggaaaccagagcagtgcctggacccttccaaggaatgggcttctgatgcctctactgagtgtgatcttcttaaatggcaactgtgcccgtgaagaggaaatctgggaattcctgaatatgctggggatctatgatggaaagaggcaccttatctttggggaaccccgaaagctcatcacccaagatctggtacaggaaaaatatctggaataccagcaggtgcccaacagtgatcccccacgctatcaattcctgtggggtccaagagctcatgcagaaaccagcaagatgaaagtcctggagtttttggccaaggtgaatgacaccacccccaataacttcccactgctttatgaagaggctttgagagatgaagaagagagagctggagcccggcccagagttgcagccaggcgtggcactacagccatgactagtgcgtattccagggccacatccagtagctcttcccaacccatgtgagatctaaggcaaattgttcactttgtggttgaaagacctgctgctttctctgttcctgtgatgcatgaataactcattgatttatctctttgttgtattttccatgatgtttcttaaaatagaaagtttatttagattcagaatataaatttagaaatggcatgcatcacacatttattgctgtttatcaggttggtttagtgataataattttgtttttgaaatacaaatagaaaatcctgaaataatttttgtgatacagagcaaaataacacggcatgggagtaaggttatccttagaaatttaaaataactccacagtaaaataggtagaatctgaagatagaaagggaagaaaagtaaaagttgctttattcgtggtttgtcttactcagttcagtctttttttgctcataaatttaaaagttacatacctggtttgcttagattattcaagaatgtggaggcctgggccaaggtcaatgacagtgtctccattgtcttccctccattaagagaagactttaagagatgagggagagagagccagagacagtgttgcaactgggcctggcatgtttcagtgtggtgtccagcagtgtctcccactccttgtgaagtctgaggtatattctttacttttgattaagaaaacacttaaccttctaattaatggagagccaaaggggagttggtgggaacaccatgtataacatatttgtatgtaaaatgatttatcttttctttttcctgtttttcagtgttctttttttaaattgtagatttatttagtttcagaatctaagtttatgaatggcatgaatcactcatttattaaaatatatcaggttggagagtgagaatttttgcattatgtaaaacaatttaaaaatcttttaagtctttttctgtgatctagaacaagataatatggcattggaatatggaatttgtgaaaaggaaattaccttgcaataaagttggtgggaccaggaagtagagaaaaaaaaagtaaaa

SEQ ID NO: 152562 - DNA, 1216 bp, Homo sapiens
  Payload ID: 10014
  Gene Symbol: MAGEB5
  Gene Name: melanoma antigen family B5
  Uniprot ID: Q9BZ81
  ENST ID: ENST00000602297
  CDS Start-End: 248-1075
ttactctcagccttgggacaacgaggacagagtcaacatgtctcaggatcagaacagtaagctccacacttgtgagaaacactaccagatccaagatgactctctgcttcagagtggagctcaggccagtgaataagtggaagatgatcccctccccacttcctctcctattcttggggatattccccagagctcatctgctgctgagtcaagtggcacttcccaggagccttgcgaatccagcaccatgacttctgcaggtgtttttaatgcaggatctgacgaaagggctaacagtagagatgaggagtacccatgttcctcagaggtctcaccctccactgagagttcatgcagcaatttcataaatattaaggtgggtttgttggagcagttcctgctctacaagttcaaaatgaaacagcgtattttgaaggaagatatgctgaagattgtcaacccaagataccaaaaccagtttgctgagattcacagaagagcttctgagcacattgaggttgtctttgcagttgacttgaaggaagtcaacccaacttgtcacttatatgaccttgtcagcaagctgaaactccccaacaatgggaggattcatgttggcaaagtgttacccaagactggtctcctcatgactttcctggttgtgatcttcctgaaaggcaactgtgccaacaaggaagatacctggaaatttctggatatgatgcaaatatatgatgggaagaagtactacatctatggagagcccaggaagctcatcactcaggatttcgtgaggctaacgtacctggagtaccaccaggtgccctgcagttatcctgcacactatcaattcctttggggtccaagagcctatactgaaaccagcaagatgaaagtcctggaatatttggccaaggtcaatgatattgctccaggtgccttctcatcacaatatgaagaggctttgcaagatgaggaagagagcccaagccagagatgcagccgaaactggcactactgcagtggccaagactgtctcagggcgaagttcagcagcttctctcaaccctattgaagtctgaagcttttttcatccagtcaagcaaatataacatcaccaaaagggattttttttggaaatacaaaagaacccccagtaaaataattgagataatgaaatagaaaaaaataataaaacatgatcttggttttcttc

SEQ ID NO: 152563 - DNA, 1949 bp, Homo sapiens
  Payload ID: 10015
  Gene Symbol: MAGEB6
  Gene Name: melanoma antigen family B6
  Uniprot ID: Q8N7X4
  ENST ID: ENST00000379034
  CDS Start-End: 150-1373
aataaaggggtctgagccggtcgcctgagcctgaaaagtgctgtcacgtcagcggaaggaggcgtcccagatcttctcagctgtcttggtgccagccttcctagtcttcctacccacactcctacctgctgtcacaggccacagccatcatgcctcggggtcacaagagtaagctccgtacctgtgagaaacgccaagagaccaatggtcagccacagggtctcacgggtccccaggccactgcagagaagcaggaagagtcccactcttcctcatcctcttctcgcgcttgtctgggtgattgtcgtaggtcttctgatgcctccattcctcaggagtctcagggagtgtcacccactgggtctcctgatgcagttgtttcatattcaaaatccgatgtggctgccaacggccaagatgagaaaagtccaagcacctcccgtgatgcctccgttcctcaggagtctcagggagcttcacccactggctctcctgatgcaggtgtttcaggctcaaaatatgatgtggctgccaacggccaagatgagaaaagtccaagcacttcccatgatgtctccgttcctcaggagtctcagggagcttcacccactggctcgcctgatgcaggtgtttcaggctcaaaatatgatgtggctgccgagggtgaagatgaggaaagtgtaagcgcctcacagaaagccatcatttttaagcgcttaagcaaagatgctgtaaagaagaaggcgtgcacgttggcgcaattcctgcagaagaagtttgagaagaaagagtccattttgaaggcagacatgctgaagtgtgtccgcagagagtacaagccctacttccctcagatcctcaacagaacctcccaacatttggtggtggcctttggcgttgaattgaaagaaatggattccagcggcgagtcctacacccttgtcagcaagctaggcctccccagtgaaggaattctgagtggtgataatgcgctgccgaagtcgggtctcctgatgtcgctcctggttgtgatcttcatgaacggcaactgtgccactgaagaggaggtctgggagttcctgggtctgttggggatatatgatgggatcctgcattcaatctatggggatgctcggaagatcattactgaagatttggtgcaagataagtacgtggtttaccggcaggtgtgcaacagtgatcctccatgctatgagttcctgtggggtccacgagcctatgctgaaaccaccaagatgagagtcctgcgtgttttggccgacagcagtaacaccagtcccggtttatacccacatctgtatgaagacgctttgatagatgaggtagagagagcattgagactgagagcttaaggcagggctggcactatttccttggccagggtaccttatggggccatatcctacagatcctcccatttctagggaggtctgaagtagaattttcactttatgttagaagagagtagtgagctttctaagtagtgcagtatagtagaggctggagggaacaagatatgtatctttcttttgttacacatgagtaacttgcagatttatgttttatctctgtcagttatcaacattgttcctgttaagtgaaggtttattttgcttcagattatacaattatcaataacatagctctcacattcatggctgtttaaccaatctgaaagttacggtttgggaattaataaaacaaagtcatacaacacattttctttgtaattgagaactagataacatggtaacagagaattgattttcatatgaatcttaactccacagtaaaatagttgacatcataatatgaagagaaagaaaaggaaaaacagaaatgtaaaagttgtttaattcttggtttgcctaattcgttttcctatttcttttcatacaaataaaggatacctggatttatttaggtta

SEQ ID NO: 152564 - DNA, 1224 bp, Homo sapiens
  Payload ID: 10016
  Gene Symbol: MAGEB6P1
  Gene Name: melanoma antigen family B6 pseudogene 1
  ENST ID: ENST00000416929
  CDS Start-End: 1-1224
atgcctcggggtcagaagagtaagctccgtgcccgtgggaaacgccgagagacccatgatcagccgcaaggtctcacaggtccccaggccactgcagagaaacaagaagagtctcgctcttcgtcatcctcttctgctgtttgtcagggtgctcgtcgtaggtcttctggttcctccgttcctcaggagtctcagggagcttcacccactggctatcctgatgcaggtgcttcatgctcaaaatatgatgtggctgccatgggtcaagatgagaaaagtcctagtacctcccgtgatgcctccgtttctcaagagtctcagggagcttcacccattggccctcctgatgcaggtatttcatgctcaaaatctgatgaggctgccaagggtcaaaatgagaaaagtccaagcacctcccgtgatgcctctgttcctcaggagtctcagggagcttcacccactggctcgcctgatgcagatgtttcaggctcaaaatctgatgtggctgccaagggtcaagatgaggaaagtttaagctcctccaagagagctgcgttctttacaaccacagacggagatcctataaaaaggaaggcaaacaagatggtgcaattcctgcagaagaagtttgagaagaaagagcccattttgaaggcagacatgctgaagcgtctccgcagacagtacaagccatgcttccctgagatcctcaagagaacctccgaacatttgacggtgttctttggcgttgaattgaaagaaacggattccagcggcgagtcctacacccttgtcagcaagctgggtctctccaatgaaggaagtctgagtggtgataatgcgctgccgaagtcgggtctcctgatgtcgatcctgggtttgatcttcatgagaggcaaccgtgccactgaagaggaggtctggaagttcctgggtctgttggggatatatgatgggatcctgcattcaatctatggggatgctcggaagatcattactgaagatttggtgcaagataagtacgtggtttaccggcaggtgtgcaacagtgatcctccatgctatgagttcctgtggggtccacgagcctatgctgaaaccaccaagatgagagtcctgcgtgttttggccgagatcaataacaccagtcccggtttatacccacatctgtatgaagacgctttgacagatgaggtagagagagcattgagactgagagcttaa

SEQ ID NO: 152565 - DNA, 4270 bp, Homo sapiens
  Payload ID: 10017
  Gene Symbol: MAGEC1
  Gene Name: melanoma antigen family C1
  Uniprot ID: O60732
  ENST ID: ENST00000285879
  CDS Start-End: 287-3715
gtctgaaggacctgaggcattttgtgacgaggatcgtctcaggtcagcggagggaggagacttatagacctatccagtcttcaaggtgctccagaaagcaggagttgaagacctgggtgtgagggacacatacatcctaaaagcaccacagcagaggaggcccaggcagtgccaggagtcaaggttcccagaagacaaaccccctaggaagacaggcgacctgtgaggccctagagcaccaccttaagagaagaagagctgtaagccggcctttgtcagagccatcatgggggacaaggatatgcctactgctgggatgccgagtcttctccagagttcctctgagagtcctcagagttgtcctgagggggaggactcccagtctcctctccagattccccagagttctcctgagagcgacgacaccctgtatcctctccagagtcctcagagtcgttctgagggggaggactcctcggatcctctccagagacctcctgaggggaaggactcccagtctcctctccagattccccagagttctcctgagggcgacgacacccagtctcctctccagaattctcagagttctcctgaggggaaggactccctgtctcctctagagatttctcagagccctcctgagggtgaggatgtccagtctcctctgcagaatcctgcgagttccttcttctcctctgctttattgagtattttccagagttcccctgagagtactcaaagtccttttgagggttttccccagtctgttctccagattcctgtgagcgccgcctcctcctccactttagtgagtattttccagagttcccctgagagtactcaaagtccttttgagggttttccccagtctccactccagattcctgtgagccgctccttctcctccactttattgagtattttccagagttcccctgagagaactcagagtacttttgagggttttgcccagtctcctctccagattcctgtgagcccctcctcctcctccactttactgagtcttttccagagtttctctgagagaactcagagtacttttgagggttttgcccagtcttctctccagattcctgtgagcccctccttctcctccactttagtgagtcttttccagagttcccctgagagaactcagagtacttttgagggttttccccagtctcctctccagattcctgtgagctcctcctcctcctccactttattgagtcttttccagagttcccctgagagaactcacagtacttttgagggttttccccagtctcttctccagattcctatgacctcctccttctcctctactttattgagtattttccagagttctcctgagagtgctcaaagtacttttgagggttttccccagtctcctctccagattcctgggagcccctccttctcctccactttactgagtcttttccagagttcccctgagagaactcacagtacttttgagggttttccccagtctcctctccagattcctatgacctcctccttctcctctactttattgagtattttacagagttctcctgagagtgctcaaagtgcttttgagggttttccccagtctcctctccagattcctgtgagctcctctttctcctacactttattgagtcttttccagagttcccctgagagaactcacagtacttttgagggttttccccagtctcctctccagattcctgtgagctcctcctcctcctcctccactttattgagtcttttccagagttcccctgagtgtactcaaagtacttttgagggttttccccagtctcctctccagattcctcagagtcctcctgaaggggagaatacccattctcctctccagattgttccaagtcttcctgagtgggaggactccctgtctcctcactactttcctcagagccctcctcagggggaggactccctatctcctcactactttcctcagagccctcctcagggggaggactccctgtctcctcactactttcctcagagccctcagggggaggactccctgtctcctcactactttcctcagagccctcctcagggggaggactccatgtctcctctctactttcctcagagtcctcttcagggggaggaattccagtcttctctccagagccctgtgagcatctgctcctcctccactccatccagtcttccccagagtttccctgagagttctcagagtcctcctgaggggcctgtccagtctcctctccatagtcctcagagccctcctgaggggatgcactcccaatctcctctccagagtcctgagagtgctcctgagggggaggattccctgtctcctctccaaattcctcagagtcctcttgagggagaggactccctgtcttctctccattttcctcagagtcctcctgagtgggaggactccctctctcctctccactttcctcagtttcctcctcagggggaggacttccagtcttctctccagagtcctgtgagtatctgctcctcctccacttctttgagtcttccccagagtttccctgagagtcctcagagtcctcctgaggggcctgctcagtctcctctccagagacctgtcagctccttcttctcctacactttagcgagtcttctccaaagttcccatgagagtcctcagagtcctcctgaggggcctgcccagtctcctctccagagtcctgtgagctccttcccctcctccacttcatcgagtctttcccagagttctcctgtgagctccttcccctcctccacttcatcgagtctttccaagagttcccctgagagtcctctccagagtcctgtgatctccttctcctcctccacttcattgagcccattcagtgaagagtccagcagcccagtagatgaatatacaagttcctcagacaccttgctagagagtgattccttgacagacagcgagtccttgatagagagcgagcccttgttcacttatacactggatgaaaaggtggacgagttggcgcggtttcttctcctcaaatatcaagtgaagcagcctatcacaaaggcagagatgctgacgaatgtcatcagcaggtacacgggctactttcctgtgatcttcaggaaagcccgtgagttcatagagatactttttggcatttccctgagagaagtggaccctgatgactcctatgtctttgtaaacacattagacctcacctctgaggggtgtctgagtgatgagcagggcatgtcccagaaccgcctcctgattcttattctgagtatcatcttcataaagggcacctatgcctctgaggaggtcatctgggatgtgctgagtggaataggggtgcgtgctgggagggagcactttgcctttggggagcccagggagctcctcactaaagtttgggtgcaggaacattacctagagtaccgggaggtgcccaactcttctcctcctcgttacgaattcctgtggggtccaagagctcattcagaagtcattaagaggaaagtagtagagtttttggccatgctaaagaataccgtccctattacctttccatcctcttacaaggatgctttgaaagatgtggaagagagagcccaggccataattgacaccacagatgattcgactgccacagaaagtgcaagctccagtgtcatgtcccccagcttctcttctgagtgaagtctagggcagattcttccctctgagtttgaagggggcagtcgagtttctacgtggtggagggcctggttgaggctggagagaacacagtgctatttgcatttctgttccatatgggtagttatggggtttacctgttttacttttgggtatttttcaaatgcttttcctattaataacaggtttaaatagcttcagaatcctagtttatgcacatgagtcgcacatgtattgctgtttttctggtttaagagtaacagtttgatattttgtaaaaacaaaaacacacccaaacacaccacattgggaaaaccttctgcctcattttgtgatgtgtcacaggttaatgtggtgttactgtaggaattttcttgaaactgtgaaggaactctgcagttaaatagtggaataaagtaaaggattgttaatgtttgcatttcctcaggtcctttagtctgttgttcttgaaaactaaagatacatacctggtttgcttggcttacgtaagaaagtagaagaaagtaaactgtaataaataaaagtgtcagtgactca

SEQ ID NO: 152566 - DNA, 1084 bp, Homo sapiens
  Payload ID: 10017
  Gene Symbol: MAGEC1
  Gene Name: melanoma antigen family C1
  Uniprot ID: O60732
  ENST ID: ENST00000406005
  CDS Start-End: 374-1003
gccaggagtcaaggttcccagaagacaaaccccctaggaagacaggcgacctgtgaggccctagagcaccaccttaagagaagaagagctgtaagccggcctttgtcagagccatcatgggggacaaggatatgcctactgctgggatgccgagtcttctccagagttcctctgagagtcctcagagttgtcctgagggggaggactcccagtctcctctccagattccccagagttctcctgagagcgacgacacccttccttgatagagagcgagcccttgttcacttatacactggatgaaaaggtggacgagttggcgcggtttcttctcctcaaatatcaagtgaagcagcctatcacaaaggcagagatgctgacgaatgtcatcagcaggtacacgggctactttcctgtgatcttcaggaaagcccgtgagttcatagagatactttttggcatttccctgagagaagtggaccctgatgactcctatgtctttgtaaacacattagacctcacctctgaggggtgtctgagtgatgagcagggcatgtcccagaaccgcctcctgattcttattctgagtatcatcttcataaagggcacctatgcctctgaggaggtcatctgggatgtgctgagtggaataggggtgcgtgctgggagggagcactttgcctttggggagcccagggagctcctcactaaagtttgggtgcaggaacattacctagagtaccgggaggtgcccaactcttctcctcctcgttacgaattcctgtggggtccaagagctcattcagaagtcattaagaggaaagtagtagagtttttggccatgctaaagaataccgtccctattacctttccatcctcttacaaggatgctttgaaagatgtggaagagagagcccaggccataattgacaccacagatgattcgactgccacagaaagtgcaagctccagtgtcatgtcccccagcttctcttctgagtgaagtctagggcagattcttccctctgagtttgaagggggcagtcgagtttctacgtggtggagggcctggttgaggctggag

SEQ ID NO: 152567 - DNA, 1991 bp, Homo sapiens
  Payload ID: 10018
  Gene Symbol: MAGEC2
  Gene Name: melanoma antigen family C2
  Uniprot ID: Q9UBF1
  ENST ID: ENST00000247452
  CDS Start-End: 349-1470
gctttcccgacggccatcttgggaatctgacggatcgaaggcatttgtgaggaggcgcgaatcaagttagcggggggaagagtcttagacctggccagtcctcagggtgagggccctgaggaagaactgagggacctcccaccatagagagaagaaaccccggcctgtactgcgctgccgtgagactggtgctccaggaaccaggtggtgacgaactgggtgtgaggcacacagcctaaagtcagcacagcagaggaggcccaggcagtgccaggagtcaaggcctgttggatctcatcatccatatccctgttgatacgtttacctgctgctcctgaagaagtcgtcatgcctcccgttccaggcgttccattccgcaacgttgacaacgactccccgacctcagttgagttagaagactgggtagatgcacagcatcccacagatgaggaagaggaggaagcctcctccgcctcttccactttgtacttagtattttccccctcttctttctccacatcctcttctctgattcttggtggtcctgaggaggaggaggtgccctctggtgtgataccaaatcttaccgagagcattcccagtagtcctccacagggtcctccacagggtccttcccagagtcctctgagctcctgctgctcctctttttcatggagctcattcagtgaggagtccagcagccagaaaggggaggatacaggcacctgtcagggcctgccagacagtgagtcctctttcacatatacactagatgaaaaggtggccgagttagtggagttcctgctcctcaaatacgaagcagaggagcctgtaacagaggcagagatgctgatgattgtcatcaagtacaaagattactttcctgtgatactcaagagagcccgtgagttcatggagcttctttttggccttgccctgatagaagtgggccctgaccacttctgtgtgtttgcaaacacagtaggcctcaccgatgagggtagtgatgatgagggcatgcccgagaacagcctcctgattattattctgagtgtgatcttcataaagggcaactgtgcctctgaggaggtcatctgggaagtgctgaatgcagtaggggtatatgctgggagggagcacttcgtctatggggagcctagggagctcctcactaaagtttgggtgcagggacattacctggagtatcgggaggtgccccacagttctcctccatattatgaattcctgtggggtccgagagcccattcagaaagcatcaagaagaaagtactagagtttttagccaagctgaacaacactgttcctagttcctttccatcctggtacaaggatgctttgaaagatgtggaagagagagtccaggccacaattgataccgcagatgatgccactgtcatggccagtgaaagcctcagtgtcatgtccagcaacgtctccttttctgagtgaagtctaggatagtttcttccccttgtgtttgaacagggcagtttaggttctaggtagtggagggccaggtggggctcgaggaacgtagtgttctttgcatttctgtcccatatgggtgatgtagagatttacctgtttttcagtattttctaaatgcttttcctttgaatagcaggtagttagcttcagagtgttaatttatgaatattagtcgcacatgtattgctctttatctggtttaagagtaacagtttgatattttgttaaaaaaatggaaataccttctcccttattttgtgatctgtaacagggtagtgtggtattgtaataggcatttttttttttttttacaatgtgcaataactcagcagttaaatagtggaacaaaattgaagggtggtcagtagtttcatttccttgtcctgcttattcttttgttcttgaaaattatatatacctggctttgcttagcttgttgaagaaagtagcagaaattaaatcttaataaaagaaagccccac

SEQ ID NO: 152568 - DNA, 1932 bp, Homo sapiens
  Payload ID: 10019
  Gene Symbol: MAGEC3
  Gene Name: melanoma antigen family C3
  Uniprot ID: Q8TD91
  ENST ID: ENST00000298296
  CDS Start-End: 1-1932
atgctgctgccctgccactgggtgttggatgccaccttcagtgatggcagtctaggccagtgggtgaaaaacacatgtgccacatatgccttatccccagtggtgctcccacctcagccccagccccggaaaaaggccacagataaggactattctgcctttcatcttgggcatctgagggaggtgaggctttttctgaggggtggaacttcagatcagcgaatggatagtcttgtcctctgccccacatacttcaagctctggaggaccctatcagggtccccaggtttacaactttctgacttgcattttgggagtcagccggaggggaagttttctctgaggagggcagtttcagttaagcagagggaggaaccccaggactggccactcaacgagaagagaactctgtggaaggacagtgaccttccaacatggaggagaggcacaggctacaccctttcccttcctgccgtcagccctggaaaaaggttgtggggggagaaagcggggagcttgccagagagcgagcccttgttcacttatacactggatgaaaaggtggacaagttggtgcagtttcttctcctcaaatatcaagcaaaagagcctctcacaagagcagagatgcagatgaatgtcatcaacacatacacgggctactttcctatgatcttcaggaaagcccgtgagttcatagagattctttttggcatttccctgacagaagtggaccccgaccatttctatgtctttgtaaacacattagacctcacctgtgaggggagtctgagtgatgagcagggcatgccccagaaccgcctcctgattcttattctgagtgtgatcttcataaagggcaactgtgcatctgaggaggtcatctgggaagtgctgaatgcaatagggccctggtcagccttggcagggttcgcggatgtgctttcccgacttgcactgtgggagtctgaaggacctgaagcattttgcgaggagtctggactcaggtcagcagagggaagcgtcttagacctggccaatcctcaaggacttgcaggccacagacaggaagatggccgccgagggctgaccgaggcgtccccacaacagaagaagggaggagaagatgaggatatgcctgctgctgggatgccacctcttccccagagtcctcctgagattcctccccagggtcctcccaagatctctccccagggtcctccgcagagtcctccccagagtcctctagactcctgctcatcccctcttttgtggacccgattggatgaggagtccagcagtgaagaggaggatacagctacttggcatgccttgccagaaagtgaatccttgcccaggtatgccctggatgaaaaggtggctgagttggtgcagtttcttctcctcaaatatcaaacaaaagagcctgtcacaaaggcagagatgctgacgactgtcatcaagaagtataaggactattttcccatgatcttcgggaaagcccatgagttcatagagctaatttttggcattgccctgactgatatggaccccgacaaccactcctatttctttgaagacacattagacctcacctatgagggaagcctgattgatgaccagggcatgcccaagaactgtctcctgattcttattctcagtatgatcttcataaagggcagctgtgtccccgaggaggtcatctgggaagtgttgagtgcaatagggcccattcagaggccagcaagagaagtcttagagtttttatccaagctatccagtatcatccctagtgcctttccatcctggtacatggatgctttgaaagatatggaagacagagcccaggccataattgacaccacagatgatgctactgccatggccagtgcaagccccagtgtcatgtccaccaacttctgtcctgagtga

SEQ ID NO: 152569 - DNA, 1290 bp, Homo sapiens
  Payload ID: 10019
  Gene Symbol: MAGEC3
  Gene Name: melanoma antigen family C3
  Uniprot ID: Q8TD91
  ENST ID: ENST00000409007
  CDS Start-End: 111-1151
gtcagcacagcagaggaggcccaggcaatatcaggagtcaaggcctgtgggatcccatcatccccatccctgctcacacgtttacctgctgctcctgaacaacaggcctcatgcctctctttccaaaccttccacgcctcagctttgaggaagacttccagaacccgagtgtgacagaggacttggtagatgcacaggattccatagatgaggaggaggaggatgcctcctccacttcctcttcctctttccactttttattcccctcctcctcttccttgtcctcatcctcacccttgtcctcacccttaccctctactctcattctgggtgttccagaagatgaggatatgcctgctgctgggatgccacctcttccccagagtcctcctgagattcctccccagggtcctcccaagatctctccccagggtcctccgcagagtcctccccagagtcctctagactcctgctcatcccctcttttgtggacccgattggatgaggagtccagcagtgaagaggaggatacagctacttggcatgccttgccagaaagtgaatccttgcccaggtatgccctggatgaaaaggtggctgagttggtgcagtttcttctcctcaaatatcaaacaaaagagcctgtcacaaaggcagagatgctgacgactgtcatcaagaagtataaggactattttcccatgatcttcgggaaagcccatgagttcatagagctaatttttggcattgccctgactgatatggaccccgacaaccactcctatttctttgaagacacattagacctcacctatgagggaagcctgattgatgaccagggcatgcccaagaactgtctcctgattcttattctcagtatgatcttcataaagggcagctgtgtccccgaggaggtcatctgggaagtgttgagtgcaataggggtgtgtgctgggagggagcactttatatatggggatcccagaaagctgctcactatacattgggtgcagagaaagtacctggagtaccgggaggtgcccaacagtgctcctccacgttatgaatttttgtggggtccaagagcccattcagaggccagcaagagaagtcttagagtttttatccaagctatccagtatcatccctagtgcctttccatcctggtacatggatgctttgaaagatatggaagacagagcccaggccataattgacaccacagatgatgctactgccatggccagtgcaagccccagtgtcatgtccaccaacttctgtcctgagtga

SEQ ID NO: 152570 - DNA, 1100 bp, Homo sapiens
  Payload ID: 10019
  Gene Symbol: MAGEC3
  Gene Name: melanoma antigen family C3
  ENST ID: ENST00000443323
  CDS Start-End: 161-961
gtcagcacagcagaggaggcccaggcaatatcaggagtcaaggttctgagggagcaaacctcttaggaagacaggcgacctgtgaggccctagagcaccaccttaagagaagaagagctgtaagccagcctttgtcagaaccatcatagaagatgaggatatgcctgctgctgggatgccacctcttccccagagtcctcctgagattcctccccagggtcctcccaagatctctccccagggtcctccgcagagtcctccccagagtcctctagactcctgctcatcccctcttttgtggacccgattggatgaggagtccagcagtgaagaggaggatacagctacttggcatgccttgccagaaagtgaatccttgcccaggtatgccctggatgaaaaggtggctgagttggtgcagtttcttctcctcaaatatcaaacaaaagagcctgtcacaaaggcagagatgctgacgactgtcatcaagaagtataaggactattttcccatgatcttcgggaaagcccatgagttcatagagctaatttttggcattgccctgactgatatggaccccgacaaccactcctatttctttgaagacacattagacctcacctatgagggaagcctgattgatgaccagggcatgcccaagaactgtctcctgattcttattctcagtatgatcttcataaagggcagctgtgtccccgaggaggtcatctgggaagtgttgagtgcaataggggtgtgtgctgggagggagcactttatatatggggatcccagaaagctgctcactatacattgggtgcagagaaagtacctggagtaccgggaggtgcccaacagtgctcctccacgttatgaatttttgtggggtccaagagcccattcagaggccagcaagagaagtcttagagtttttatccaagctatccagtatcatccctagtgcctttccatcctggtacatggatgctttgaaagatatggaagacagagcccaggccataattgacaccacagatgatgctactgccatggccagtgcaagccccagtgtcatgtccaccaacttctgtcctgagtga

SEQ ID NO: 152571 - DNA, 1707 bp, Homo sapiens
  Payload ID: 10019
  Gene Symbol: MAGEC3
  Gene Name: melanoma antigen family C3
  Uniprot ID: Q8TD91
  ENST ID: ENST00000544766
  CDS Start-End: 528-1568
gaaaggagccccggggctggccaacaagcaagaagggaactctgtggaaggatagctatctcccaacacggagggaaggcccaggcgtcgcccagccactccttgctgtcacccctggacaaaacagatggagaggtgaaaacggagagccctggtcagccttggcagggttcgcggatgtgctttcccgacttgcactgtgggagtctgaaggacctgaagcattttgcgaggagtctggactcaggtcagcagagggaagcgtcttagacctggccaatcctcaaggtgctccaggaaccaggagttgaagacctgggtctgaggcacacttcctaaagtcagcacagcagaggaggcccaggcaatatcaggagtcaaggttctgagggagcaaacctcttaggaagacaggcgacctgtgaggccctagagcaccaccttaagagaagaagagctgcctgtgggatcccatcatccccatccctgctcacacgtttacctgctgctcctgaacaacaggcctcatgcctctctttccaaaccttccacgcctcagctttgaggaagacttccagaacccgagtgtgacagaggacttggtagatgcacaggattccatagatgaggaggaggaggatgcctcctccacttcctcttcctctttccactttttattcccctcctcctcttccttgtcctcatcctcacccttgtcctcacccttaccctctactctcattctgggtgttccagaagatgaggatatgcctgctgctgggatgccacctcttccccagagtcctcctgagattcctccccagggtcctcccaagatctctccccagggtcctccgcagagtcctccccagagtcctctagactcctgctcatcccctcttttgtggacccgattggatgaggagtccagcagtgaagaggaggatacagctacttggcatgccttgccagaaagtgaatccttgcccaggtatgccctggatgaaaaggtggctgagttggtgcagtttcttctcctcaaatatcaaacaaaagagcctgtcacaaaggcagagatgctgacgactgtcatcaagaagtataaggactattttcccatgatcttcgggaaagcccatgagttcatagagctaatttttggcattgccctgactgatatggaccccgacaaccactcctatttctttgaagacacattagacctcacctatgagggaagcctgattgatgaccagggcatgcccaagaactgtctcctgattcttattctcagtatgatcttcataaagggcagctgtgtccccgaggaggtcatctgggaagtgttgagtgcaataggggtgtgtgctgggagggagcactttatatatggggatcccagaaagctgctcactatacattgggtgcagagaaagtacctggagtaccgggaggtgcccaacagtgctcctccacgttatgaatttttgtggggtccaagagcccattcagaggccagcaagagaagtcttagagtttttatccaagctatccagtatcatccctagtgcctttccatcctggtacatggatgctttgaaagatatggaagacagagcccaggccataattgacaccacagatgatgctactgccatggccagtgcaagccccagtgtcatgtccaccaacttctgtcctgagtga

SEQ ID NO: 152572 - DNA, 2747 bp, Homo sapiens
  Payload ID: 10020
  Gene Symbol: MAGED1
  Gene Name: melanoma antigen family D1
  Uniprot ID: Q9Y5V3
  ENST ID: ENST00000326587
  CDS Start-End: 191-2527
ggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaatta

SEQ ID NO: 152573 - DNA, 2875 bp, Homo sapiens
  Payload ID: 10020
  Gene Symbol: MAGED1
  Gene Name: melanoma antigen family D1
  Uniprot ID: Q9Y5V3
  ENST ID: ENST00000375695
  CDS Start-End: 154-2658
attttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccagaatcctgacgcttgtagagcagtctgtcaccccctcccccagcctcctgcctccaccctccctctttctgcattccccactctgtgcgaccccccttattctcaactccgcgatccgcctgccgtcctgagctgctactgcacgcctcttggagcgtccccggctcctgctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaa

SEQ ID NO: 152574 - DNA, 2806 bp, Homo sapiens
  Payload ID: 10020
  Gene Symbol: MAGED1
  Gene Name: melanoma antigen family D1
  Uniprot ID: Q9Y5V3
  ENST ID: ENST00000375722
  CDS Start-End: 253-2589
cgggactgactttggctcttcagtgtttgcgcatgcgcgtaacgtcctgaggcggtgggtggtatattaggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaa

SEQ ID NO: 152575 - DNA, 2701 bp, Homo sapiens
  Payload ID: 10020
  Gene Symbol: MAGED1
  Gene Name: melanoma antigen family D1
  Uniprot ID: Q9Y5V3
  ENST ID: ENST00000375772
  CDS Start-End: 148-2484
gaagttgcctgaagtgaaggagggggtagcggctgcagaagctaaagcttccgccaaacaaaagaggacagcacttccggtcacgccatcgttgctgccttcttcgtcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaa

SEQ ID NO: 152576 - DNA, 1958 bp, Homo sapiens
  Payload ID: 10021
  Gene Symbol: MAGED2
  Gene Name: melanoma antigen family D2
  Uniprot ID: Q9UNF1
  ENST ID: ENST00000218439
  CDS Start-End: 126-1946
gcgggaccacttccggcctagagaggggagggcagtctccgagtttcggaggggcttggagtgagtggacgcactcgggaattgtaggaggacgaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtat

SEQ ID NO: 152577 - DNA, 2177 bp, Homo sapiens
  Payload ID: 10021
  Gene Symbol: MAGED2
  Gene Name: melanoma antigen family D2
  ENST ID: ENST00000347546
  CDS Start-End: 86-1852
gacttcgagagggacttagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtatctgccttggtttcagtggggacatctggggcttatggggctgggatgaggagctggatgattctaggaaggcccaagttggagaatgatgtggagagtgtgccaagacactgcttttggcattttattcctttctgtttgctggatgtcaattgacccttttattttctcttacttgtgttttcagatattgttaatcctgccagtctttctcttcaagccagggtgcatcctcagaaacctactcaacacagcactctaggcagccactatcaatcaattgaagttgacactctgcattaaatctatttgcc

SEQ ID NO: 152578 - DNA, 2066 bp, Homo sapiens
  Payload ID: 10021
  Gene Symbol: MAGED2
  Gene Name: melanoma antigen family D2
  Uniprot ID: Q9UNF1
  ENST ID: ENST00000375053
  CDS Start-End: 234-2054
agtggcataaacatgggctttggcgtcagacagccctgagcggggccccattgccccacccccgaggaaggcgagggggggtggcagggggctgcggaaaggggctgggctgggttgggctgtctgcagctctagtccaggaggctgagacttcgagagggacttagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtat

SEQ ID NO: 152579 - DNA, 2048 bp, Homo sapiens
  Payload ID: 10021
  Gene Symbol: MAGED2
  Gene Name: melanoma antigen family D2
  Uniprot ID: Q9UNF1
  ENST ID: ENST00000375058
  CDS Start-End: 93-1913
agtctccgagtttcggaggggcttggagtgagtggacgcactcgggaattgtaggaggacgaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgcc

SEQ ID NO: 152580 - DNA, 1798 bp, Homo sapiens
  Payload ID: 10021
  Gene Symbol: MAGED2
  Gene Name: melanoma antigen family D2
  ENST ID: ENST00000375060
  CDS Start-End: 93-1658
agtctccgagtttcggaggggcttggagtgagtggacgcactcgggaattgtaggaggacgaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttc

SEQ ID NO: 152581 - DNA, 2189 bp, Homo sapiens
  Payload ID: 10021
  Gene Symbol: MAGED2
  Gene Name: melanoma antigen family D2
  Uniprot ID: Q9UNF1
  ENST ID: ENST00000375068
  CDS Start-End: 234-2054
agtggcataaacatgggctttggcgtcagacagccctgagcggggccccattgccccacccccgaggaaggcgagggggggtggcagggggctgcggaaaggggctgggctgggttgggctgtctgcagctctagtccaggaggctgagacttcgagagggacttagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgcc

SEQ ID NO: 152582 - DNA, 2026 bp, Homo sapiens
  Payload ID: 10021
  Gene Symbol: MAGED2
  Gene Name: melanoma antigen family D2
  Uniprot ID: Q9UNF1
  ENST ID: ENST00000396224
  CDS Start-End: 194-2014
gggaaaaggggcggggtcctcagagctgccgcgctggcacatcttcctggagaaggggagggtgcggctgcagagaattgagacttagaagctttgaattcctgtatctgagaacggagtcgttgggggtggtggagggggttggaattggggacctacggaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtat

SEQ ID NO: 152583 - DNA, 1811 bp, Homo sapiens
  Payload ID: 10021
  Gene Symbol: MAGED2
  Gene Name: melanoma antigen family D2
  ENST ID: ENST00000627068
  CDS Start-End: 234-1799
agtggcataaacatgggctttggcgtcagacagccctgagcggggccccattgccccacccccgaggaaggcgagggggggtggcagggggctgcggaaaggggctgggctgggttgggctgtctgcagctctagtccaggaggctgagacttcgagagggacttagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtat

SEQ ID NO: 152584 - DNA, 2495 bp, Homo sapiens
  Payload ID: 10022
  Gene Symbol: MAGED4
  Gene Name: melanoma antigen family D4
  Uniprot ID: Q96JG8
  ENST ID: ENST00000375626
  CDS Start-End: 56-2275
gcggctgcggggttcctggtgctgaggacggacgccattggagttcccgagaagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 152585 - DNA, 2669 bp, Homo sapiens
  Payload ID: 10022
  Gene Symbol: MAGED4
  Gene Name: melanoma antigen family D4
  Uniprot ID: Q96JG8
  ENST ID: ENST00000599522
  CDS Start-End: 196-2469
gcatgcgcaggctacccagccgcggggggtgcacggagaaaaggggcggggtggtccgggctgctgtgctggcagcagtaggcgagggcgcggctgcggggttcctggtgctgaggacggacgccattggagttcccgagaagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagaacccggagctcagagaggagacgcctctgagcatggctcccagctggtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaatt

SEQ ID NO: 152586 - DNA, 2578 bp, Homo sapiens
  Payload ID: 10023
  Gene Symbol: MAGED4B
  Gene Name: melanoma antigen family D4B
  Uniprot ID: Q96JG8
  ENST ID: ENST00000335504
  CDS Start-End: 151-2376
gggggtgcacggagaaaaggggcggggtggtccgggctgctgtgctggcagcagtaggcgagggcgcggctgcggggttcctggtgctgaggacggacgccattggagttcccgagaaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 152587 - DNA, 2510 bp, Homo sapiens
  Payload ID: 10023
  Gene Symbol: MAGED4B
  Gene Name: melanoma antigen family D4B
  Uniprot ID: Q96JG8
  ENST ID: ENST00000360134
  CDS Start-End: 71-2290
gcagtaggcgagggcgcggctgcggggttcctggtgctgaggacggacgccattggagttcccgagaagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 152588 - DNA, 2618 bp, Homo sapiens
  Payload ID: 10023
  Gene Symbol: MAGED4B
  Gene Name: melanoma antigen family D4B
  Uniprot ID: Q96JG8
  ENST ID: ENST00000485287
  CDS Start-End: 143-2416
gtccgggctgctgtgctggcagcagtaggcgagggcgcggctgcggggttcctggtgctgaggacggacgccattggagttcccgagaagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagaacccggagctcagagaggagacgcctctgagcatggctcccagctggtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 152589 - DNA, 534 bp, Homo sapiens
  Payload ID: 10023
  Gene Symbol: MAGED4B
  Gene Name: melanoma antigen family D4B
  ENST ID: ENST00000481193
  CDS Start-End: 1-147
gtgtcccttccctgcccacaccccttcagtgaagcaggaagacggggcttgagtgcggcgcaccgctcccacacacagcgagggctgcctggtgactgctggatgaaaggaatgatagcctgggaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccaga

SEQ ID NO: 152590 - DNA, 917 bp, Homo sapiens
  Payload ID: 10023
  Gene Symbol: MAGED4B
  Gene Name: melanoma antigen family D4B
  ENST ID: ENST00000490581
  CDS Start-End: 1-101
ctgtcctctgggaggcactacgcaagatgggactgcgccctgggtatgattggcctctccagctcctcccctcggtgctatcctctggccaaagagggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 152591 - DNA, 2482 bp, Homo sapiens
  Payload ID: 10023
  Gene Symbol: MAGED4B
  Gene Name: melanoma antigen family D4B
  Uniprot ID: Q96JG8
  ENST ID: ENST00000497164
  CDS Start-End: 55-2280
cggctgcggggttcctggtgctgaggacggacgccattggagttcccgagaagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 152592 - DNA, 889 bp, Homo sapiens
  Payload ID: 10023
  Gene Symbol: MAGED4B
  Gene Name: melanoma antigen family D4B
  ENST ID: ENST00000486010
  CDS Start-End: 75-889
gttcctggtgctgaggacggacgccattggagttcccgagaaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtg

SEQ ID NO: 152593 - DNA, 3630 bp, Homo sapiens
  Payload ID: 10024
  Gene Symbol: MAGEE1
  Gene Name: melanoma antigen family E1
  Uniprot ID: Q9HCI5
  ENST ID: ENST00000361470
  CDS Start-End: 208-3081
attcactgctggccagtgcctgcctttttcaccacctctaatttcagcttcagcagttgcttggaactttggttctggcagcagcagcaacatcattaccgctagcggcagttttgtgccgaggcacctacacacctcccgtcctctctgccagatcgcgggcctgtcggtgtctgctcctacacgccaacgccggtgggcaggaccatgtctctggtaagccagaattcgcgccgccgccgccgccgcgttgcaaaggctactgcgcacaacagcagctggggcgaaatgcaggcccctaatgcccccggtctccccgctgatgtgccaggctcagacgtcccccagggtcccagcgattcccagatcctccagggcctctgcgcctctgagggcccaagcacctccgttctgcccacctccgctgagggcccaagcacctttgtgccgcccaccatctctgaggcctcaagcgcctccgggcagcccaccatctctgagggacctggcacctccgtgctgcccacccccagtgagggcctaagcacctccgggcctcccaccatctctaaggggctgtgcacctctgtgacgcttgccgcctctgagggccggaacacctccaggccgcccacttcctctgaggaacctagcacctccgtgccgcccaccgcctctgaggtaccgagcacctccctgccgcccacccctggtgagggaacgagcacctccgtgccgcccacagcctatgagggaccaagcacctccgtggtgcccacccctgatgagggaccaagcacctccgtgctgcctacacctggtgagggaccaggcacctccgtgccgctcgccgccactgagggcctgagcacctccgtgcaggccactcctgatgagggaccgagcacctccgtgccgcccaccgccactgagggcctaagcacccccgtgccacccacccgtgatgagggaccgagcacctccgtgccggccactcctggtgagggaccgagcacctccgtgctgcccgccgcctctgacggacaaagcatctccttggtgcccacccgcggtaagggatcaagcacctccgtgccccccaccgccaccgagggcctgagcacctccgtgcagcccactgctggtgagggatcgagcacctccgtgccgcccacccctggtgggggactgagcacctccgtgccgcccaccgccactgaggagttgagcacctccgtgccgcccactcccggtgagggaccaagcacttccgtactgccaatccccggtgagggactgagcacctctgtgccgcccaccgcctctgatggatcggacacctccgtgccgcccactcctggtgagggcgcaagcaccttagtgcagcccaccgcccctgacggaccgggaagctccgtgctgcctaaccctggtgagggcccgagcacattgtttagctctagtgcttctgtggaccggaacccctccaagtgttcccttgttttgccaagccctagggtaaccaaggcctccgtggactcagattctgagggtcctaagggtgcagaaggccctatagaattcgaggtcctgagagactgtgagagccccaactccattagtattatgggcctcaatacttcccgggttgcaattaccctgaagccccaagaccctatggaacagaacgtagctgagctgttgcagttcctgctggtgaaggatcagagcaagtaccctatccgggagtctgaaatgcgggaatatattgttaaagaatatcgcaaccagtttcctgagatactcaggcgagcagcagcccacctggagtgcatttttaggtttgaattgagagaacttgaccctgaggcacacacctacattctgttaaacaaactgggacctgtgccctttgaagggttagaagagagcccaaatgggccaaagatgggcctcctgatgatgattctaggccaaatattcctgaatggcaaccaagccaaggaggctgagatttgggaaatgctctggaggatgggggtgcagcgggaaaggaggctttccatttttgggaacccaaagagacttctgtctgtggagtttgtatggcagcgttacttagactacaggccagtaactgactgtaaaccagtggagtatgagtttttctggggcccaagatcccacctagaaaccaccaagatgaaaattctgaagttcatggcgaaaatatataacaaagatcctatggattggccagagaaatacaacgaagctctggaagaagatgctgccagagcctttgctgagggttggcaggctctccctcactttaggaggcccttttttgaggaagctgctgcagaggtaccatcccctgattcagaggtttccagctattcctcaaaatatgccccacattcatggcctgagtcaagattggagagcaaggcaaggaagctggtgcagttatttctgcttatggattcaactaagctgcctataccaaagaaaggaattctgtactacattggccgagagtgcagcaaagtgttccctgacctcctgaatcgtgctgcccgcaccctgaaccatgtctatgggacagaactagtggtacttgatcccaggaatcactcctatactctgtacaaccgaagggagatggaagaaactgaggagatcgtagacagtccaaacaggcctggcaacaactttttgatgcaggtcctaagcttcatctttattatgggcaaccatgccagggagtctgcagtctgggcctttctgcggggcttaggggttcaagctgggagaaagcatgtgattacctgcagatacttgagtcagcgctatatagacagtttacgggttcctgacagtgatccagtgcaatatgagtttgtatggggtcctagagcccgtttggaaacctctaagatgaaagccttgcgatatgtggccagaatccacagaaaggaaccacaggactggccacagcagtacagggaggcaatggaagatgaggccaatagagctgatgttgggcacaggcaaatctttgttcacaacttcaggtagaggaatgcatggcagtcagaggggccttgcaaggaggggcctttgagcctcagttctcatgtattggggggtgggggtgggtacatattgtatttggtatttgtgttccagttatatttatgtcttttcatatttagttctggtgtggtgtctggaaatgtttcaactgttttaatatattgtctgattgggtaaatgtgattgaccacttgctgtctctgttgtattttggtatgagttttgatagctctataaaatgttttggaaatctttccatcttgttgcattatctagaaaagaatatagcatatagctatagatataggcttttccttgaaagcttgaaaaaaattcgccagtaaaataatctagcttaaagtgataaactaacaaacaaatataacaacaactgaaaaggcactctaaattgtggctggcttccctttctgtctgctattgtatgaagaatactgatgtttacctgtatttgctttgctgtactaaaatgtaatgaaaaataaaagattaataaatgaaacataatgctaa

SEQ ID NO: 152594 - DNA, 2249 bp, Homo sapiens
  Payload ID: 10025
  Gene Symbol: MAGEE2
  Gene Name: melanoma antigen family E2
  Uniprot ID: Q8TD90
  ENST ID: ENST00000373359
  CDS Start-End: 186-1757
gaggcttgcagtcgttgctggccagcacttgtgtagaaagatcgctcttcacaccagatttcacttttgatccttccagctccagggtctcgggcttcagctttgtgccgaggcaccaacactgctgcggtcctctctccgactgatcgctgatctcaccgttcccgctcctgtctcctggaaccatgtctctggtaagccagaatgcacgccactgtagcgcagagatcactgcagattacggcgacggcagaggtgaaatacaagctactaacgcctccgggtcccccacctccatgctagtcgttgatgccccccagtgccctcaggcgccaatcaactctcagtgtgtcaacacttcccaggccgttcaggacccgaatgacctggaggtcctgatcgacgagcagtccagacgtttgggggcgctcagggtccatgaccctctagaagacaggtcgattgctttggtgaatttcatgagaatgaaaagccagacggaggggtctatccagcagtccgagatgctggagtttctcagagagtactcagatcagttccctgagatcctcagacgagcctcagctcacctggaccaggtctttgggttgaacctgagagttattgatcctcaggctgacacctacaatttagtcagcaaacggggtttccagatcaccgataggatagcggagtccctggacatgccaaaagcaagtctcctggccctagtcctaggccacatcctcttgaatgggaaccgagcaagagaggcctccatttgggacttgctgctaaaagttgatatgtgggataagcctcagaggatcaacaacctctttgggaacacaaggaacctcctcactactgactttgtgtgcatgcgattcttggagtactggccggtgtatggcactaatccccttgagtttgagttcttgtggggctctagagcccacagggaaatcacaaagatggaagccctgaagtttgtgtcagatgcccatgatgaagaaccctggagctggccagaagaatataataaggccctggaaggtgacaaaaccaaagaaagaagcctgactgctggcttagagttctggtcggaggacactatgaatgataaggcaaatgatttggtccagttggctattagtgtcactgaggagatgctgcctatacatcaggatgagctattggctcacactggcaaagaatttgaggatgtgttcccaaatatcctcaatagagctactctaattcttgatatgttctatgggttgtctctgattgaggttgataccagtgagcacatctacctccttgtccagcaaccagaatcagaggaagagcaagtgatgctagagagcctggggagacccactcaagaatatgtaatgccaatcctaggtttgatcttcctgatgggcaaccgtgtcaaagaggccaatgtctggaacttgcttcgaagatttagtgtggatgtagggagaaagcattccatcacccgtaagcttatgagacagcgctatctggaatgcaggccactgtcctactctaatccagttgaatatgagcttctatggggtcctcgagctcaccatgaaaccatcaaaatgaaagtcttggagtacatggccaggctctacagaaagcgaccacagaactggccagaacaatatagggaggctgtggaagatgaggaggccagagccaaatctgaggcaactatcatgtttttccttgaccccacgtgaagtctagggaatatgtatcacttcagctgagtggcataagttaaagatgccttggtaaaataggcattggggctctaaattagaatccaggtagggcttgtgtgggaagtacaaattgtgcttgctgtctgtgttccaattctagtagtatttccttccttttaatatactcttggattaggttaatgaccaatatttataaatggaatttttcatttgccatcccggtcttgtttcagcataaaagttcagacagctctgtaaaatgtattgataatatttacatctttgaaataatcagtaaaatggtctggtacaggagttaaataacaatgacacacacacaacaaaacaaacacaaaaccactgatctgtgattgctctccctttgtgtctactgccgtatacatatatacaactatatatacacaaatatatatatacacaaaactgtcatttacctgtatttgcaataaaagcataatgaattag

SEQ ID NO: 152595 - DNA, 1636 bp, Homo sapiens
  Payload ID: 10026
  Gene Symbol: MAGEF1
  Gene Name: melanoma antigen family F1
  Uniprot ID: Q9HAY2
  ENST ID: ENST00000317897
  CDS Start-End: 182-1105
gcgttgcggccgcaggtttgactcccgtgcggtgcggcccagcagccacaaagctcccgctgccattgctccttgtactcccgccgtcactgccgctgtccaacccctcccccggggcttgcgcggcggctcccacacccctcggcccgtgtacgcgctctgcacctgcctgcccgaaaacatgttgcagacaccagagagcagggggctcccggtcccgcaggccgagggggagaaggatggcggccatgatggtgagacccgggccccgaccgcctcgcaggagcgccccaaggaggagcttggcgccgggagggaggagggggctgcggagcccgccctcacccggaaaggcgcgagggccttggcggccaaagccttggcaaggcgcagggcctaccgccggctgaatcggacggtggcggagttggtgcagttcctcctggtgaaagacaagaagaagagtcccatcacacgctcggagatggtgaaatacgttattggagacttgaagattctgttcccggacatcatcgcaagggccgcagagcatctgcggtatgtctttggttttgagctgaaacagtttgaccgcaagcaccacacttacatcctgatcaacaaactaaaacctctggaggaggaggaggaggaggatctgggaggagatggccccagattgggtctgttaatgatgatcctgggccttatctatatgagaggtaatagcgccagggaggcccaggtctgggagatgctgcgtcggttgggggtgcaaccctcaaagtatcatttcctctttgggtatccgaagaggcttattatggaagattttgtgcagcagcgatatctcagttacaggcgggtgcctcacaccaatccaccagaatatgaattctcttggggtccccgaagcaacctggaaatcagcaagatggaagtcctggggttcgtggccaaactgcataagaaggaaccgcagcactggccagtgcagtaccgtgaggccctagcagacgaggccgacagggccagagccaaggccagagctgaagccagtatgagggccagggccagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagctatttgagtatctagagaaaaattaaaatgcaatgagttagcagtataccctggcacacttaataaattaaacatttgtgga

SEQ ID NO: 152596 - DNA, 1462 bp, Homo sapiens
  Payload ID: 10027
  Gene Symbol: MAGEH1
  Gene Name: melanoma antigen family H1
  Uniprot ID: Q9H213
  ENST ID: ENST00000342972
  CDS Start-End: 271-930
gcgtggcaggagaggcggggccaattttgctgagctttctcgcgggcttgcagctgcggcaagtgctggcggcggctgctcgcgcaagtcagctggcgtgggaactaccctttgtagctgagaacggcttgtttattgctacaaagactctattgacattggtagcttcagcggcagcagcttcttacggtataaagctgttgcttcctgaagaggctacaagcatccttccctaggactgctgtaagctttgagcctctagcaggagacatgcctcggggacgaaagagtcggcgccgccgtaatgcgagagccgcagaagagaaccgcaacaatcgcaaaatccaggcctcagaggcctccgagacccctatggccgcctctgtggtagcgagcacccccgaagacgacctgagcggccccgaggaagacccgagcactccagaggaggcctctaccacccctgaagaagcctcgagcactgcccaagcacaaaagccttcagtgccccggagcaattttcagggcaccaagaaaagtctcctgatgtctatattagcgctcatcttcatcatgggcaacagcgccaaggaagctctggtctggaaagtgctggggaagttaggaatgcagcctggacgtcagcacagcatctttggagatccgaagaagatcgtcacagaagagtttgtgcgcagagggtacctgatttataaaccggtgccccgtagcagtccggtggagtatgagttcttctgggggccccgagcacacgtggaatcgagcaaactgaaagtcatgcattttgtggcaagggttcgtaaccgatgctctaaagactggccttgtaattatgactgggattcggacgatgatgcagaggttgaggctatcctcaattcaggtgctaggggttattccgccccttaagtagatctgaggcagacccttgggggtgtaaaagagagtcacaggtaccccaaggagtagatgccagggtcctaagttgaaaatgatgtcgattgggggcgggggacactgtatttgatatttgtgatcagtgatcattgttcaactgcgaaatagagtgtttgcttttgataatggaaaattgtattcgttttaaaattccgtttgttgagaataacaatatgtttaaaaatataattgaacaaatttttttctttgtttcctgtcattgacatttagtataacagttttgctaacgttctaaaatgaagtcgttccatcataatctatgatcttgtacagcacttatagaaataagctgttcttttgaagttgaaatacccagtaaaatgttgaagaaggatggaggatttcttcatatctgacgtttctgaaaccctttgtgtctgctgttgtgtgaagattgacatttaccatgattttccttagttactgcagaacatagagaaaaataaaagcctaacgaatagta

SEQ ID NO: 152597 - DNA, 4298 bp, Homo sapiens
  Payload ID: 10028
  Gene Symbol: MAGEL2
  Gene Name: melanoma antigen family L2
  Uniprot ID: Q9UJ55
  ENST ID: ENST00000532292
  CDS Start-End: 100-3849
gggagcctctgaacagccacgtaggcattctcttctctctggaggaaaaggcccagcagctgtccgaggaaaagacccaccagctgtcagcaaagggacatgtcgcagctaagtaagaatctgggtgactcgagtcctccggcggaggccccgaagccgcctgtctatagccgccctacggttctgatgcgggccccgcccgcttcctcccgggctccgccagtcccttgggatccacctccaattgacttgcaggcttcattggccgcttggcaggcacctcagcctgcctgggaggccccacagggccagctgcccgccccggtggttccgatgacccagcctcctgccctagggggcccgatagtcccggctcccccgctggggggcccgatgggtaagcctccgactcccggggtcctgatggtgcatcctccacctccgggagccccgatggcccagcctccgaccccgggagtcctgatggtgcatccttcagctcccggagctcccatggcccatcctcctcctccggggaccccaatgtcccaccctccccctccggggaccccaatggcccatcctcctcctccggggaccccgatggcccatcctcctcctccggggaccccgatggtgcatcctcctcctccggggaccccgatggctcatcctccccctccggggacaccgatggctcatcctccccctccggggacaccgatggctcatcctccacctccggggacaccgatggctcatcctccccctccgggtacaccgatggcccagcctccagctccgggagtcctgatggcccagcctctgactccgggagtcctgatggtccagcctgctgctccgggagcaccgatggtccagccgcctccagcagccatgatgacccagcctcagccttcaggagcaccgatggccaagcctccaggtccaggagtcctgatgattcatcctccaggtgcgagagctccgatgacccagcctccagcttcaggagcaccgatggcacagccggcggccccacctgcacagccgatggccccacctgcacagccgatggcttcttgggccccgcaggctcagcctctgatcctgcaaatccagtctcaagttataagggctcctccgcaggttccccagggcccgcaggcacccccagcgcagctagccacacccccgggctggcaggcgacctcgccaggatggcaggccacgcagcaaggctggcaggccactcccctgacttggcagaccacgcaggtcacctggcaggcaccagccgttacctggcaggtgccgccgcccatgcgccaggggcccccgcccatccgccctggcccaccacccatccgccctggcccaccaccggtgcgacaggccccaccgctgatccgccaggccccaccggtgatccgccaggccccacccgtgatccgccaggccccacccgtgatccgccaggcccccgctgtgatccgccaggccccacctgtgatccgccaggccccacctgtgatccgccaggctccacctgtgatccgccaggccccgccgctgatccgccaggcgccgccgcccatccgacctgccccacaggtcctggccacccagccaccgctctggcaggccctgccacccccacctccactgcggcaggccccgcaggctaggctgccggccccgcaggtgcaggcggcgccgcaggtgcctacggccccacctgctacgcaggtacccgcggcgccgcccgctggcccgcaggtgccccagcctgtgctgccggccccgctgtctgccccactgtctgccccgcaggctgtgcactgcccttccatcatctggcaggcccccaaaggtcagcccccggtgccacacgagattccaacgtcaatggaattccaggaggtgcagcagacacaggcgctggcctggcaggcccagaaggcccccactcacatctggcagcccctgcctgcccaggaggcccagaggcaggctccccccttggtccagctggagcagccctttcagggagccccgccctcccaaaaagccgtgcaaatccagctacccccccagcaggcccaggcatcgggtccgcaagcggaggtgcccacactgccgctccagccttcctggcaggcaccgcctgcagtcttgcaggcccagcccggacccccggtagcagcggcaaattttcccctgggctccgctaaatcattgatgactccatcaggagaatgcagggcctcttctatagaccgcaggggctcctctaaagagcgcaggacctcctcgaaggagcgcagggccccttcaaaagaccgcatgatctttgctgccaccttctgtgctcccaaggcagtgtcagctgcgcgagcacacctgccagctgcctggaaaaacctgcctgccacaccggagacctttgctccctcctcaagtgtcttcccagctacctcccagtttcagcctgcctctctgaatgcctttaaaggcccctctgctgcctcagagaccccaaagtcactgccatatgctctgcaggatccctttgcctgtgtagaggccctgcctgcagttccatgggtcccacagcccaatatgaatgcctcaaaggcatcgcaggcagtgcccaccttcctgatggctacagcagctgccccccaggcaactgccaccactcaagaggcctccaagacctccgtcgagccgccacgccgctccggcaaggccacccggaagaagaagcatctggaagcccaagaggacagccgtggccacacgctagcctttcatgactggcagggcccaaggccctgggagaatctaaatctgagtgactgggaggtccaaagccctatccaggtctcgggtgactgggagcacccaaacaccccccgtggcctgagtggttgggagggccctagcacctccaggatcctgagtggctgggaagggcccagcgcatcctgggccctgagtgcctgggagggcccgagcacctccagggccctgggtctctctgaaagcccagggagctctctgcccgtagttgtgtctgaggtcgcaagtgtctctccgggatccagtgccacccaggataattccaaggtggaggcacagcccttgtctcccttggatgagagggcaaatgcgttggtgcagttcctcttagtcaaggaccaagccaaggtgcctgtccagcgctcggagatggtgaaagtcatcctccgagagtataaagatgagtgcttagatatcatcaaccgtgccaacaataagctggagtgtgcctttggttatcaattgaaagaaattgataccaaaaaccacgcctatattatcatcaacaagctgggctaccatacagggaatttggtggcatcctatttagacaggcccaagtttggccttctgatggtggtcttgagcctcatctttatgaaaggcaactgtgtcagggaggatctgatctttaattttctgttcaagttagggttggatgtccgggagacaaacggtctctttggaaatactaagaagctcatcaccgaagtgtttgtcaggcagaagtacctagagtacaggcgaatcccttacactgagcccgcagagtatgagttcctctggggccctcgagcattcctggaaaccagcaagatgcttgtcctgaggtttttggccaagctccataagaaagatccacagagctggccattccattaccttgaagcgctcgcagagtgtgagtgggaagacacagatgaggatgaacctgacaccggtgacagtgcccacggccccaccagcaggccccctccccgctaataggtgtagcagagatctcgctcctgtgtttccctggccagaggccactgacagggtggggggacatttttgttcctggtgtttgtgttccagttccacgagtgtacgtttggattttcaacttggtttcgtatctgccaaagctttgtacattttttatgtggtgttgatttcaatcggctactgttctgttctgtattttggcatctgtgtttttaagtgagatctgtggttctctgttttgtgttttaattgttatgttttggtatcagctttgtgctggctttgtgaaatgaattgagaagctatccatctcatttctggtatagttcatgtagcattgtaatcggttgttctttgaacgttcaaatgactcatcagtaaaaactgtctacagagaagtaaatatctatatctatatatataaatatactttcagcataacagaa

SEQ ID NO: 152598 - DNA, 2837 bp, Homo sapiens
  Payload ID: 10029
  Gene Symbol: MUM1
  Gene Name: melanoma associated antigen (mutated) 1
  Uniprot ID: Q2TAK8
  ENST ID: ENST00000415183
  CDS Start-End: 27-2225
cattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctctctagaggaaaaaattaaggtgaaaagcactgaagttgagatcctagagaagtctcaaattgaagccattgcttcctcgttagcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgagtgctgggaaatgcgagtgcgtgcgcttgaccctgtgcggagacggagccgcttacttgacccctgtgcagagatggagctgcttagaagctgtcagcaccagggggtgcgaactccctccctactgcgggcgcacagatgcttcccagcctcggtgggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatgcttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgagg

SEQ ID NO: 152599 - DNA, 2793 bp, Homo sapiens
  Payload ID: 10029
  Gene Symbol: MUM1
  Gene Name: melanoma associated antigen (mutated) 1
  ENST ID: ENST00000587460
  CDS Start-End: 27-266
cattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctctctagaggaaaaaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtcagtgcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatgcttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgagg

SEQ ID NO: 152600 - DNA, 522 bp, Homo sapiens
  Payload ID: 10029
  Gene Symbol: MUM1
  Gene Name: melanoma associated antigen (mutated) 1
  ENST ID: ENST00000592374
  CDS Start-End: 377-522
cggggtctgactgcaggacaaagggccgggagcgcgggagggcggcgcccgggagcggccacacatgccccgccaaccggtctcctcaggcagcactcccgggaaaaaggggtagacgcgcggcggaaggggcggggccggcgcgcggccgtggacgccggagagggcgaggccggcgctccttgggagcgcgcgcgtcccattgggcagcgggcggaagggggcggagcttggcgccgccgcgaggcaagccccgcccccggccccgcggggagcggcggcggcggcggcggcggcggtggcggaggcggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctctctagaggaaaa

SEQ ID NO: 152601 - DNA, 4067 bp, Homo sapiens
  Payload ID: 10029
  Gene Symbol: MUM1
  Gene Name: melanoma associated antigen (mutated) 1
  ENST ID: ENST00000591806
  CDS Start-End: 77-2212
ttcgttccaggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctctctagaggaaaaaattaaggtgaaaagcactgaagttgagatcctagagaagtctcaaattgaagccattgcttcctcgttagcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatgcttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcaggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 152602 - DNA, 1018 bp, Homo sapiens
  Payload ID: 10029
  Gene Symbol: MUM1
  Gene Name: melanoma associated antigen (mutated) 1
  ENST ID: ENST00000591337
  CDS Start-End: 226-1018
cgcggggagcggcggcggcggcggcggcggcggtggcggaggcggtgagcgcgggcggcgcggacggcagcggttggcgggcgggtcctccgctgttgcggccgctgcggcctccttgcccgggcttggggcgccgcgctggggaaagccgggggcccggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctctctagaggaaaaaattaaggtgaaaagcactgaagttgagatcctagagaagtctcaaattgaagccattgcttcctcgttagcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatc

SEQ ID NO: 152603 - DNA, 2603 bp, Homo sapiens
  Payload ID: 10029
  Gene Symbol: MUM1
  Gene Name: melanoma associated antigen (mutated) 1
  ENST ID: ENST00000591433
  CDS Start-End: 101-340
agttgtataaaccaccgtgcaaatttcgttccaggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctctctagaggaaaaaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtcagtgcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggtgagccgcggaccggcgtgtcacgtgggcagggaggggcctgcgctgggattttgcaactccgcacgaggaggctgccacggtcctcgcccctgctccctggccgttcggcggccaacggagcgtggaggcctcctgtgtttacatcctgtcagtgctgggaaatgcgagtgcgtgcgcttgaccctgtgcggagacggagccgcttacttgacccctgtgcagagatggagctgcttagaagctgtcagcaccagggggtgcgaactccctccctactgcgggcgcacagatgcttcccagcctcggtgggtcagtcctgggaaacccactgcgagttggaaattcccaagtcagaatcgcatttagtacccagataaacccactgtaagttgaaaaac

SEQ ID NO: 152604 - DNA, 867 bp, Homo sapiens
  Payload ID: 10029
  Gene Symbol: MUM1
  Gene Name: melanoma associated antigen (mutated) 1
  ENST ID: ENST00000588810
  CDS Start-End: 74-313
gttccaggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctctctagaggaaaaaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatgcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcc

SEQ ID NO: 152605 - DNA, 2235 bp, Homo sapiens
  Payload ID: 10029
  Gene Symbol: MUM1
  Gene Name: melanoma associated antigen (mutated) 1
  ENST ID: ENST00000626522
  CDS Start-End: 100-2235
gcgggtgcggcggcggcggcccgcgctccgcaggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctctctagaggaaaaaattaaggtgaaaagcactgaagttgagatcctagagaagtctcaaattgaagccattgcttcctcgttagcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtga

SEQ ID NO: 152606 - DNA, 2235 bp, Homo sapiens
  Payload ID: 10029
  Gene Symbol: MUM1
  Gene Name: melanoma associated antigen (mutated) 1
  ENST ID: ENST00000627377
  CDS Start-End: 1-2199
atgatggcggatgccaagtatgtcctctgccgatgggaaaagcgattatggcctgcgaaggttttggcccgaaccgcgacttcaacaaaaaataagagaagaaaggaatattttctagctgtgcaaatcctctctctagaggaaaaaattaaggtgaaaagcactgaagttgagatcctagagaagtctcaaattgaagccattgcttcctcgttagcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgagtgctgggaaatgcgagtgcgtgcgcttgaccctgtgcggagacggagccgcttacttgacccctgtgcagagatggagctgcttagaagctgtcagcaccagggggtgcgaactccctccctactgcgggcgcacagatgcttcccagcctcggtgggccatcatctgtgcgatctctgcggtggacgaggtggactacaagacggctgaggagaagtacatcaaggggccttcgctgagctaccg

SEQ ID NO: 152607 - DNA, 4308 bp, Homo sapiens
  Payload ID: 10030
  Gene Symbol: MUM1L1
  Gene Name: melanoma associated antigen (mutated) 1-like 1
  Uniprot ID: Q5H9M0
  ENST ID: ENST00000337685
  CDS Start-End: 786-2876
agtcttcggggaggagctgcattacacacaggcttcggaggcttccgtggagaagcttggaggtaatggctgtcgtaaatgctagttattttcagagagttctcgaagatttggaataaagccgagccccagaaagacaggtcaaccacagaagtgctgagccaggtaaagaccctgctggacaagcagctggagtgagaatcaagacagctggaccacaggaccagacccagcagtatccatgtaacaggaaaggtccccttgctattcccatcactgggagggggcggagcctcgtcggagccgctcggaagggagctgtacccggccagtattgggggaggggcagcatttcaagaggctgcagctgacaagaagcttcaagcataggttaatatcagagaagcacatgacctgggcaatctgcatgtgatgccaaccaagccttggaaagacagtgcaaccacagaagtgccgagctgggtaaaggccctgctggacaagcagttggagtgagaatcaagacagccggaccacaggaccagacccaccaggatccacatgacagtggtatcttccggtatcatcctattcaaacaacgtgttcaagcatccttggaaaattgaggtggagaacaggccacacaagctgtaaaccctttgtagtcataagacgaaagaggatttgttaagagtattgttttgggtagaacttgcattagcagtgacaaagatagccacctcaacctttggtaataacccttggcacacaaatataaaccataatggagtctgagtatgtcctatgcaactggaaagaccagttgtggccagcaaaagttttgtccagatctgaaacttcatcaaacagtaagaggaaaaaggcattttctctagaagttcaaatactctcactagatgaaaaaattaaattggacagcacagaaacaaagatcctaaataaatctcaaattgaagccattgctgcctcattaggactacagtcagaggacagtgctccacctacagaggaaactgcctatggaagatcactaaaagtggcactgggtattctgaatgagagaacaaatttgagtcaagcaagcacttcagatgaagaggagatcactatgctgtctcaaaatgtaccacaaaaacagtccgattcaccccctcataaaaaataccggaaggatgaaggtgacttaccagggtgtcttgaggaaagggaaaactcagcatgcttgttagcatcttcagagagtgatgattccctgtatgatgataaatcacaagcacccacaatggtcgatactattccaagtgaagtggaaacaaagtcattacaaaactctagctggtgcgagactttcccttcactttcggaagataatgatgaaaaagagaacaagaataagattgatatctcagcagttatgtctgtgcattctgcagtcaaagaggaaagtgcatgtgttaaagatgaaaagtttgctccacctttgtcacctttgtcatcagatatgctcattatgcccaaagctttgaaagaagagagcgaggatacctgcctagagaccctggctgttccctctgaatgctctgctttctcagagaatattgaggatcctggagagggtccctcaaatccatgcttagataccagccagaatcaaccttccatggaatcagagatgggggctgcagcatgccctgggagttgttcaagggaatgcgaggtttcatttagtgcctctaaccctgtctgggattattcacatcttatgagtagtgaaagaaattttcagagactggattttgaagaacttgaggaagaaggtcaagcctctgacaagtcattgcttccaagtcgcattaatctttctctattagatgatgatgaggaagacgaagaacttccacgcttcattttacattatgagacacatccgtttgaaacaggaatgatagtctggtttaaatatcagaaatatccattttggccagcagtgataaaaagtatcagacgaaaagagaggaaagcaagtgtgctttttgttgaggcaaacatgaattctgaaaagaagggcattagagtaaattttagaagattaaagaaatttgattgtaaagagaaacaaatgctagtggacaaagccagggaggattatagtgagagtattgactggtgcatctcactaatttgtgactacagagttagaataggttgtggttctttcacgggctctttgcttgagtattatgctgctgatattagttacccagttaggaaagaaacaaaacaggatactttcaggaacaaatttccaaagctgcataatgaagatgccagggaaccgatggctgtaacttcccagaccaagaaaatgtccttccaaaaaattctccctgaccggatgaaggctgctcgggaccgagccaacaagaacctggtggacttcattgtgaatgcaaagggaacagagaaccatcttctggccattgtaaatggcacaaaaggatccagatggctgaaatcatttttgaatgcaaataggttcacaccctgtattgaaacatactttgaggatgaagatcagttggatgaagtggtgaaatatttacaagaagtctgcaatcaaatagatcaaataatgccaacttggataaaagatgataaaattaaatttatcctagaagttcttctgccagaagcaattatttgttcaatttctgctgttgatgggttagattacgaggcagctgaagcaaagtatctaaaaggaccatgtctaggctacagggaaagagaattatttgatgcaaaaataatatatgaaaagagacgaaaagcaccaacaaatgaagctcactaaatgtgctgaaagttgaaaccatgacagggagctctcatagatactagttgaaaaaagtctctgaacaattctctctaatacatattttctgcaaatgggagcatggataatgtgttcacttttttttgagatctctaggatctgtggttataattacatctttatttccttttcttgcgcttcttcaaagttaattttgtcaacatatttcagcagttctactttcccgtacattttttagaaagcataattcctaaatgattttgaagggaaagtactattttgttttatgacacttttgagtctatgctgtattgttaaatatattgtgcacaattattttaatgttaaaattgcactggtgttagatattaacgaagatgattggaaaaaagtctgaaagatacatcatttctatattccttgcttaatttttataaaatattgggttttcccttaagatagttgaagtatttttcttgccatgcctatttatttttgcaaaaaaattatctgctatatagaaccaaagatagattcgctttgctatatattataactatacttgcttttgcaataaaacaacttgtaattcaaaaatgaagattatctgcatatagtatttatgtgtgtgaataacatcttggcatgcagaaaataattttggctgctttgaacaggattgttcattctacacttccctgaaattccatttttgggagtgtctatccttcaatggctgaatagttccttaaatcagacaagctcctggctatcttcataaccagcagtgagtagatcttcttaatatagctgtctgaccacatgtggaaggcagctagacttattgtatttacagcctggccactctagacatatgaatccaggctgactgcttaagtgcccatctcgtttgatataaactgtagaaaaggcaagcactttgttctgagtcttttatctccaaatacatagttgtctcaaaccaagcaagctttatcaaaatggcttatttgcagaatagttccaatgatataaatgccaactggcaagtcattccaaactgcttgaaggagtagatgaaccagaatctgagaatttggaaataggtcacagaaaaagcctccatttggctaaatatgacaattatctgagtatggttaaatacatacaattaaatgtctgaagccaatgagttgtttattctaacttgaaatatatttttgtgagaataaatgttagaaaagttagtttattttggaaacctgccgtgaaaggaaattctaaaggcttaacatgaaactgtctgcatttctacctgttagacaatggttgctcttgggctcttgttatacagtcatatggctacacgtttatgtaaagtttgcaaaagtttggtgttttgatttataataaaactgttatattattc

SEQ ID NO: 152608 - DNA, 4173 bp, Homo sapiens
  Payload ID: 10030
  Gene Symbol: MUM1L1
  Gene Name: melanoma associated antigen (mutated) 1-like 1
  Uniprot ID: Q5H9M0
  ENST ID: ENST00000357175
  CDS Start-End: 650-2740
agtcttcggggaggagctgcattacacacaggcttcggaggcttccgtggagaagcttggaggtaatggctgtcgtaaatgctagttattttcagagagttctcgaagatttggaataaagccgagccccagaaagacaggtcaaccacagaagtgctgagccaggtaaagaccctgctggacaagcagctggagtgagaatcaagacagctggaccacaggaccagacccagcagtatccatgtaacacataggttaatatcagagaagcacatgacctgggcaatctgcatgtgatgccaaccaagccttggaaagacagtgcaaccacagaagtgccgagctgggtaaaggccctgctggacaagcagttggagtgagaatcaagacagccggaccacaggaccagacccaccaggatccacatgacagtggtatcttccggtatcatcctattcaaacaacgtgttcaagcatccttggaaaattgaggtggagaacaggccacacaagctgtaaaccctttgtagtcataagacgaaagaggatttgttaagagtattgttttgggtagaacttgcattagcagtgacaaagatagccacctcaacctttggtaataacccttggcacacaaatataaaccataatggagtctgagtatgtcctatgcaactggaaagaccagttgtggccagcaaaagttttgtccagatctgaaacttcatcaaacagtaagaggaaaaaggcattttctctagaagttcaaatactctcactagatgaaaaaattaaattggacagcacagaaacaaagatcctaaataaatctcaaattgaagccattgctgcctcattaggactacagtcagaggacagtgctccacctacagaggaaactgcctatggaagatcactaaaagtggcactgggtattctgaatgagagaacaaatttgagtcaagcaagcacttcagatgaagaggagatcactatgctgtctcaaaatgtaccacaaaaacagtccgattcaccccctcataaaaaataccggaaggatgaaggtgacttaccagggtgtcttgaggaaagggaaaactcagcatgcttgttagcatcttcagagagtgatgattccctgtatgatgataaatcacaagcacccacaatggtcgatactattccaagtgaagtggaaacaaagtcattacaaaactctagctggtgcgagactttcccttcactttcggaagataatgatgaaaaagagaacaagaataagattgatatctcagcagttatgtctgtgcattctgcagtcaaagaggaaagtgcatgtgttaaagatgaaaagtttgctccacctttgtcacctttgtcatcagatatgctcattatgcccaaagctttgaaagaagagagcgaggatacctgcctagagaccctggctgttccctctgaatgctctgctttctcagagaatattgaggatcctggagagggtccctcaaatccatgcttagataccagccagaatcaaccttccatggaatcagagatgggggctgcagcatgccctgggagttgttcaagggaatgcgaggtttcatttagtgcctctaaccctgtctgggattattcacatcttatgagtagtgaaagaaattttcagagactggattttgaagaacttgaggaagaaggtcaagcctctgacaagtcattgcttccaagtcgcattaatctttctctattagatgatgatgaggaagacgaagaacttccacgcttcattttacattatgagacacatccgtttgaaacaggaatgatagtctggtttaaatatcagaaatatccattttggccagcagtgataaaaagtatcagacgaaaagagaggaaagcaagtgtgctttttgttgaggcaaacatgaattctgaaaagaagggcattagagtaaattttagaagattaaagaaatttgattgtaaagagaaacaaatgctagtggacaaagccagggaggattatagtgagagtattgactggtgcatctcactaatttgtgactacagagttagaataggttgtggttctttcacgggctctttgcttgagtattatgctgctgatattagttacccagttaggaaagaaacaaaacaggatactttcaggaacaaatttccaaagctgcataatgaagatgccagggaaccgatggctgtaacttcccagaccaagaaaatgtccttccaaaaaattctccctgaccggatgaaggctgctcgggaccgagccaacaagaacctggtggacttcattgtgaatgcaaagggaacagagaaccatcttctggccattgtaaatggcacaaaaggatccagatggctgaaatcatttttgaatgcaaataggttcacaccctgtattgaaacatactttgaggatgaagatcagttggatgaagtggtgaaatatttacaagaagtctgcaatcaaatagatcaaataatgccaacttggataaaagatgataaaattaaatttatcctagaagttcttctgccagaagcaattatttgttcaatttctgctgttgatgggttagattacgaggcagctgaagcaaagtatctaaaaggaccatgtctaggctacagggaaagagaattatttgatgcaaaaataatatatgaaaagagacgaaaagcaccaacaaatgaagctcactaaatgtgctgaaagttgaaaccatgacagggagctctcatagatactagttgaaaaaagtctctgaacaattctctctaatacatattttctgcaaatgggagcatggataatgtgttcacttttttttgagatctctaggatctgtggttataattacatctttatttccttttcttgcgcttcttcaaagttaattttgtcaacatatttcagcagttctactttcccgtacattttttagaaagcataattcctaaatgattttgaagggaaagtactattttgttttatgacacttttgagtctatgctgtattgttaaatatattgtgcacaattattttaatgttaaaattgcactggtgttagatattaacgaagatgattggaaaaaagtctgaaagatacatcatttctatattccttgcttaatttttataaaatattgggttttcccttaagatagttgaagtatttttcttgccatgcctatttatttttgcaaaaaaattatctgctatatagaaccaaagatagattcgctttgctatatattataactatacttgcttttgcaataaaacaacttgtaattcaaaaatgaagattatctgcatatagtatttatgtgtgtgaataacatcttggcatgcagaaaataattttggctgctttgaacaggattgttcattctacacttccctgaaattccatttttgggagtgtctatccttcaatggctgaatagttccttaaatcagacaagctcctggctatcttcataaccagcagtgagtagatcttcttaatatagctgtctgaccacatgtggaaggcagctagacttattgtatttacagcctggccactctagacatatgaatccaggctgactgcttaagtgcccatctcgtttgatataaactgtagaaaaggcaagcactttgttctgagtcttttatctccaaatacatagttgtctcaaaccaagcaagctttatcaaaatggcttatttgcagaatagttccaatgatataaatgccaactggcaagtcattccaaactgcttgaaggagtagatgaaccagaatctgagaatttggaaataggtcacagaaaaagcctccatttggctaaatatgacaattatctgagtatggttaaatacatacaattaaatgtctgaagccaatgagttgtttattctaacttgaaatatatttttgtgagaataaatgttagaaaagttagtttattttggaaacctgccgtgaaaggaaattctaaaggcttaacatgaaactgtctgcatttctacctgttagacaatggttgctcttgggctcttgttatacagtcatatggctacacgtttatgtaaagtttgcaaaagtttggtgttttgatttataataaaactgttatattattca

SEQ ID NO: 152609 - DNA, 3957 bp, Homo sapiens
  Payload ID: 10030
  Gene Symbol: MUM1L1
  Gene Name: melanoma associated antigen (mutated) 1-like 1
  Uniprot ID: Q5H9M0
  ENST ID: ENST00000372552
  CDS Start-End: 435-2525
tttcaccaggctgcagctgacaagaagcttcaagcataggttaatatcagagaagcacatgacctgggcaatctgcatgtgatgccaaccaagccttggaaagacagtgcaaccacagaagtgccgagctgggtaaaggccctgctggacaagcagttggagtgagaatcaagacagccggaccacaggaccagacccaccaggatccacatgacagtggtatcttccggtatcatcctattcaaacaacgtgttcaagcatccttggaaaattgaggtggagaacaggccacacaagctgtaaaccctttgtagtcataagacgaaagaggatttgttaagagtattgttttgggtagaacttgcattagcagtgacaaagatagccacctcaacctttggtaataacccttggcacacaaatataaaccataatggagtctgagtatgtcctatgcaactggaaagaccagttgtggccagcaaaagttttgtccagatctgaaacttcatcaaacagtaagaggaaaaaggcattttctctagaagttcaaatactctcactagatgaaaaaattaaattggacagcacagaaacaaagatcctaaataaatctcaaattgaagccattgctgcctcattaggactacagtcagaggacagtgctccacctacagaggaaactgcctatggaagatcactaaaagtggcactgggtattctgaatgagagaacaaatttgagtcaagcaagcacttcagatgaagaggagatcactatgctgtctcaaaatgtaccacaaaaacagtccgattcaccccctcataaaaaataccggaaggatgaaggtgacttaccagggtgtcttgaggaaagggaaaactcagcatgcttgttagcatcttcagagagtgatgattccctgtatgatgataaatcacaagcacccacaatggtcgatactattccaagtgaagtggaaacaaagtcattacaaaactctagctggtgcgagactttcccttcactttcggaagataatgatgaaaaagagaacaagaataagattgatatctcagcagttatgtctgtgcattctgcagtcaaagaggaaagtgcatgtgttaaagatgaaaagtttgctccacctttgtcacctttgtcatcagatatgctcattatgcccaaagctttgaaagaagagagcgaggatacctgcctagagaccctggctgttccctctgaatgctctgctttctcagagaatattgaggatcctggagagggtccctcaaatccatgcttagataccagccagaatcaaccttccatggaatcagagatgggggctgcagcatgccctgggagttgttcaagggaatgcgaggtttcatttagtgcctctaaccctgtctgggattattcacatcttatgagtagtgaaagaaattttcagagactggattttgaagaacttgaggaagaaggtcaagcctctgacaagtcattgcttccaagtcgcattaatctttctctattagatgatgatgaggaagacgaagaacttccacgcttcattttacattatgagacacatccgtttgaaacaggaatgatagtctggtttaaatatcagaaatatccattttggccagcagtgataaaaagtatcagacgaaaagagaggaaagcaagtgtgctttttgttgaggcaaacatgaattctgaaaagaagggcattagagtaaattttagaagattaaagaaatttgattgtaaagagaaacaaatgctagtggacaaagccagggaggattatagtgagagtattgactggtgcatctcactaatttgtgactacagagttagaataggttgtggttctttcacgggctctttgcttgagtattatgctgctgatattagttacccagttaggaaagaaacaaaacaggatactttcaggaacaaatttccaaagctgcataatgaagatgccagggaaccgatggctgtaacttcccagaccaagaaaatgtccttccaaaaaattctccctgaccggatgaaggctgctcgggaccgagccaacaagaacctggtggacttcattgtgaatgcaaagggaacagagaaccatcttctggccattgtaaatggcacaaaaggatccagatggctgaaatcatttttgaatgcaaataggttcacaccctgtattgaaacatactttgaggatgaagatcagttggatgaagtggtgaaatatttacaagaagtctgcaatcaaatagatcaaataatgccaacttggataaaagatgataaaattaaatttatcctagaagttcttctgccagaagcaattatttgttcaatttctgctgttgatgggttagattacgaggcagctgaagcaaagtatctaaaaggaccatgtctaggctacagggaaagagaattatttgatgcaaaaataatatatgaaaagagacgaaaagcaccaacaaatgaagctcactaaatgtgctgaaagttgaaaccatgacagggagctctcatagatactagttgaaaaaagtctctgaacaattctctctaatacatattttctgcaaatgggagcatggataatgtgttcacttttttttgagatctctaggatctgtggttataattacatctttatttccttttcttgcgcttcttcaaagttaattttgtcaacatatttcagcagttctactttcccgtacattttttagaaagcataattcctaaatgattttgaagggaaagtactattttgttttatgacacttttgagtctatgctgtattgttaaatatattgtgcacaattattttaatgttaaaattgcactggtgttagatattaacgaagatgattggaaaaaagtctgaaagatacatcatttctatattccttgcttaatttttataaaatattgggttttcccttaagatagttgaagtatttttcttgccatgcctatttatttttgcaaaaaaattatctgctatatagaaccaaagatagattcgctttgctatatattataactatacttgcttttgcaataaaacaacttgtaattcaaaaatgaagattatctgcatatagtatttatgtgtgtgaataacatcttggcatgcagaaaataattttggctgctttgaacaggattgttcattctacacttccctgaaattccatttttgggagtgtctatccttcaatggctgaatagttccttaaatcagacaagctcctggctatcttcataaccagcagtgagtagatcttcttaatatagctgtctgaccacatgtggaaggcagctagacttattgtatttacagcctggccactctagacatatgaatccaggctgactgcttaagtgcccatctcgtttgatataaactgtagaaaaggcaagcactttgttctgagtcttttatctccaaatacatagttgtctcaaaccaagcaagctttatcaaaatggcttatttgcagaatagttccaatgatataaatgccaactggcaagtcattccaaactgcttgaaggagtagatgaaccagaatctgagaatttggaaataggtcacagaaaaagcctccatttggctaaatatgacaattatctgagtatggttaaatacatacaattaaatgtctgaagccaatgagttgtttattctaacttgaaatatatttttgtgagaataaatgttagaaaagttagtttattttggaaacctgccgtgaaaggaaattctaaaggcttaacatgaaactgtctgcatttctacctgttagacaatggttgctcttgggctcttgttatacagtcatatggctacacgtttatgtaaagtttgcaaaagtttggtgttttgatttataataaaactgttatattattc

SEQ ID NO: 152610 - DNA, 2686 bp, Homo sapiens
  Payload ID: 10030
  Gene Symbol: MUM1L1
  Gene Name: melanoma associated antigen (mutated) 1-like 1
  ENST ID: ENST00000619455
  CDS Start-End: 650-1924
agtcttcggggaggagctgcattacacacaggcttcggaggcttccgtggagaagcttggaggtaatggctgtcgtaaatgctagttattttcagagagttctcgaagatttggaataaagccgagccccagaaagacaggtcaaccacagaagtgctgagccaggtaaagaccctgctggacaagcagctggagtgagaatcaagacagctggaccacaggaccagacccagcagtatccatgtaacacataggttaatatcagagaagcacatgacctgggcaatctgcatgtgatgccaaccaagccttggaaagacagtgcaaccacagaagtgccgagctgggtaaaggccctgctggacaagcagttggagtgagaatcaagacagccggaccacaggaccagacccaccaggatccacatgacagtggtatcttccggtatcatcctattcaaacaacgtgttcaagcatccttggaaaattgaggtggagaacaggccacacaagctgtaaaccctttgtagtcataagacgaaagaggatttgttaagagtattgttttgggtagaacttgcattagcagtgacaaagatagccacctcaacctttggtaataacccttggcacacaaatataaaccataatggagtctgagtatgtcctatgcaactggaaagaccagttgtggccagcaaaagttttgtccagatctgaaacttcatcaaacagtaagaggaaaaaggcattttctctagaagttcaaatactctcactagatgaaaaaattaaattggacagcacagaaacaaagatcctaaataaatctcaaattgaagccattgctgcctcattaggactacagtcagaggacagtgctccacctacagaggaaactgcctatggaagatcactaaaagtggcactgggtattctgaatgagagaacaaatttgagtcaagcaagcacttcagatgaagaggagatcactatgctgtctcaaaatgtaccacaaaaacagtccgattcaccccctcataaaaaataccggaaggatgaaggtgacttaccagggtgtcttgaggaaagggaaaactcagcatgcttgttagcatcttcagagagtgatgattccctgtatgatgataaatcacaagcacccacaatggtcgatactattccaagtgaagtggaaacaaagtcattacaaaactctagctggtgcgagactttcccttcactttcggaagataatgatgaaaaagagaacaagaataagattgatatctcagcagttatgtctgtgcattctgcagtcaaagaggaaagtgcatgtgttaaagatgaaaagtttgctccacctttgtcacctttgtcatcagatatgctcattatgcccaaagctttgaaagaagagagcgaggatacctgcctagagaccctggctgttccctctgaatgctctgctttctcagagaatattgaggatcctggagagggtccctcaaatccatgcttagataccagccagaatcaaccttccatggaatcagagatgggggctgcagcatgccctgggagttgttcaagggaatgcgaggtttcatttagtgcctctaaccctgtctgggattattcacatcttatgagtagtgaaagaaattttcagagactggattttgaagaacttgaggaagaaggtcaagcctctgacaagtcattgcttccaagtcgcattaatctttctctattagatgatgatgaggaagacgaagaacttccacgcttcattttacattatgagacacatccgtttgaaacaggaatgatagtctggtttaaatatcagaaatatccatttggcagcagtgataaaaagtatcagacgaaaagagaggaaagcaagtgtgctttttgttgaggcaaacatgaattctgaaaagaagggcattagagtaaattttagaagattaaagaaatttgattgtaaagagaaacaaatgctagtggacaaagccagggaggattatagtgagagtattgactggtgcatctcactaatttgtgactacagagttagaataggttgtggttctttcacgggctctttgcttgagtattatgctgctgatattagttacccagttaggaaagaaacaaaacaggatactttcaggaacaaatttccaaagctgcataatgaagatgccagggaaccgatggctgtaacttcccagaccaagaaaatgtccttccaaaaaattctccctgaccggatgaaggctgctcgggaccgagccaacaagaacctggtggacttcattgtgaatgcaaagggaacagagaaccatcttctggccattgtaaatggcacaaaaggatccagatggctgaaatcatttttgaatgcaaataggttcacaccctgtattgaaacatactttgaggatgaagatcagttggatgaagtggtgaaatatttacaagaagtctgcaatcaaatagatcaaataatgccaacttggataaaagatgataaaattaaatttatcctagaagttcttctgccagaagcaattatttgttcaatttctgctgttgatgggttagattacgaggcagctgaagcaaagtatctaaaaggaccatgtctaggctacagggaaagagaattatttgatgc

SEQ ID NO: 152611 - DNA, 3313 bp, Homo sapiens
  Payload ID: 10031
  Gene Symbol: MCAM
  Gene Name: melanoma cell adhesion molecule
  Uniprot ID: P43121
  ENST ID: ENST00000264036
  CDS Start-End: 16-1956
ctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctacccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctcctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagatacgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaa

SEQ ID NO: 152612 - DNA, 632 bp, Homo sapiens
  Payload ID: 10032
  Gene Symbol: MIA
  Gene Name: melanoma inhibitory activity
  Uniprot ID: Q16674
  ENST ID: ENST00000263369
  CDS Start-End: 167-562
gttctggtttcatagcaacttctaggtggtgtgggcgaagtttgggactggtttagggcggggacaagaccaagaacacaagtttccttgtactacgggagagagggaggggaggaaattggagaccccagcacccccttgctcactctcttgctcacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttggctttatgcaaatacaatcagcccagtgcaaa

SEQ ID NO: 152613 - DNA, 455 bp, Homo sapiens
  Payload ID: 10032
  Gene Symbol: MIA
  Gene Name: melanoma inhibitory activity
  Uniprot ID: Q16674
  ENST ID: ENST00000597784
  CDS Start-End: 53-448
ctaggcctctgtgattgttgaggagggggctgtcactgggaaagtttccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagc

SEQ ID NO: 152614 - DNA, 507 bp, Homo sapiens
  Payload ID: 10032
  Gene Symbol: MIA
  Gene Name: melanoma inhibitory activity
  Uniprot ID: Q16674
  ENST ID: ENST00000594436
  CDS Start-End: 42-437
cttctgtggccagaggggacagcggaggagcccagtccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttggctttatgcaaatacaatcagcccagtgcaaa

SEQ ID NO: 152615 - DNA, 410 bp, Homo sapiens
  Payload ID: 10032
  Gene Symbol: MIA
  Gene Name: melanoma inhibitory activity
  ENST ID: ENST00000597140
  CDS Start-End: 1-287
cccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttggctttatgcaaatacaatcagcccagtgcaaa

SEQ ID NO: 152616 - DNA, 325 bp, Homo sapiens
  Payload ID: 10032
  Gene Symbol: MIA
  Gene Name: melanoma inhibitory activity
  ENST ID: ENST00000601159
  CDS Start-End: 1-176
ggtccctggtgtgccttggtgtcatcatcttgctgtctgccttctccggacctggtgtcaggggtggtcctatgcccaagctggctgaccggaagctgtgtgcggaccaggagtgcagccgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttggctttatgcaaatacaatcagcccagtgcaaa

SEQ ID NO: 152617 - DNA, 559 bp, Homo sapiens
  Payload ID: 10032
  Gene Symbol: MIA
  Gene Name: melanoma inhibitory activity
  ENST ID: ENST00000597600
  CDS Start-End: 423-559
aggtagacagaaaagttctccaagtcctcaccggcccagaggcccagccatcttcacctctcaagctgtctgtagaggtccacgtgtcaagaaaactgaggacagaggccctcagtccagttcccacaagcaactgcatctccccaacagctgcctgaatgagtttggaagcagtcctcccaccattcagccttcagatgaaactgcacccctggctgacaggctgattgcagccttatagcagaccttaagcctgagacattcgacccacagaaaaggtgataattttggtctttttttttctaaacaggttcttgctctagagtgcagtggcacgatcatggctcactgcggcctctacatcctgggttcaagtggtcctcccacctcaacctcctgagtggctgggactacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctc

SEQ ID NO: 152618 - DNA, 2570 bp, Homo sapiens
  Payload ID: 10033
  Gene Symbol: MIA2
  Gene Name: melanoma inhibitory activity 2
  Uniprot ID: Q96PC5
  ENST ID: ENST00000280082
  CDS Start-End: 200-2164
aaaacagacagtgtttgtctctcaagttaaaccaacaagccgatagaaaaaggtagttatcaagagatttttaaaacttcaaccctttttctcttatagttagtgaagagagtagaatatctccagttttggctgacatctctacaacctgaacaattggcttaaacttcacttgggattcccggttgcttgttttagcatggcaaaatttggcgttcacagaatccttcttctggctatttctctgacaaagtgtctggagagtacaaaactgctggcagaccttaaaaaatgtggtgacttggaatgtgaagctttaataaacagagtctcagccatgagagattatagaggacctgactgccgatacctgaacttcactaagggagaagagatatctgtttatgttaaacttgcaggagaaagggaagatttgtgggcaggaagtaaaggaaaggagtttggatattttcccagagatgcagtccagattgaagaggtgttcatatctgaggaaattcagatgtcaacgaaagaatctgactttctttgtcttcttggagtaagttacacatttgacaatgaagatagtgaattaaacggtgattatggtgaaaatatatatccttatgaagaagataaagatgaaaaatctagtatatatgaaagtgattttcagatagaacctggattttatgcaacttatgaaagtactttgtttgaagaccaagttccagcattagaggctcctgaagatatcggaagtaccagtgaatcaaaagactgggaagaagtagttgttgaaagtatggaacaggatcgtattccagaagtgcatgtcccaccatcttcagctgtgtctggagtcaaagaatggtttggattgggaggagaacaagctgaagagaaggcttttgaatcagttattgaacctgtacaagaaagctcatttcggagtagaaaaatagcagtggaagatgagaatgacctagaggaattaaataatggtgagcctcaaacagaacatcagcaagaatctgaatcagaaattgattcagtgccaaagacacagtctgaactagcatctgagtcagagcacattcccaaacctcaatccactggttggtttggtggaggatttacaagttatttaggttttggagatgaggatacagggcttgaattaatagctgaagaaagcaatccaccactacaagattttcccaattccatatcatctgataaagaagccacagttccatgtacagaaatattaacagaaaaaaaagacacaatcactaatgatagcttgagtctcaagccaagttggtttgattttggttttgctatactaggctttgcatatgccaaggaagataaaattatgttagatgacaggaaaaatgaagaagatggtggggcagatgaacatgaacatcctctaacaagtgaattagaccctgaaaaagaacaagaaatagaaacgataaaaattatagaaacagaagatcaaatagacaagaaaccagtctcagaaaaaacagacgaatctgatactataccatatttgaaaaagttcttgtataattttgacaacccttggaacttccagaacattccaaaggaaacagaattgccatttcccaaacagatactggatcaaaataatgtaattgaaaatgaagaaactggagaattttccattgataattatcccacagataatacaaaagttatgatattcaaaagttcatacagtctgtcagatatggtctctaacatagagttacctacgagaattcacgaagaagtatattttgaaccctcatcttctaaagatagtgatgaaaattcgaaaccatcagtagacaccgaagggcctgctctggtggagatagacagatctgtggaaaataccctgctaaatagtcagatggtttcaactgataactctttgtcttctcaaaattatatttctcagaaagaagatgcttctgagtttcagattctgaaatacttattccaaattgatgtttatgatttcatgaattctgcattttcaccaattgtaattcttacagaaagggtaagtttgccttttaaaccttttgcaataattttacctattttgctaaatataagagtggctacaaaatatgtttgaatgaatcctccctgtttaatgtttatataatgtttctctttccatgacatcttacctgtaagatttctctttatatgaatgttttgtcaaatggatattgatttttaaaaacatttccctaagttttgttgatgttgatcttgagcggtgtttgctttttactccaccctccccatttttcaaattagggaaagttaggtactaaataagttaactcaggaataataggaactagagctgggtgtggtggtgtgtgcctggagttcccactacttaggaggctgaggcaggaggatccttttactgaatgtaacaaggagaataaaagggaagagtgagcccaagggtttgagaccagtctgggcaacatagctagaccttatctcttaaaaaagaaaaaaaaaaa

SEQ ID NO: 152619 - DNA, 554 bp, Homo sapiens
  Payload ID: 10033
  Gene Symbol: MIA2
  Gene Name: melanoma inhibitory activity 2
  ENST ID: ENST00000557148
  CDS Start-End: 278-554
agggttgctctgtgattctatgtctagagatgtgatctccctatgttgctcaggctgcccaggctggtctcgaactcctgggctcaagtgattctcctgctttggcctctcaaagtgctggggttacaggcatgagccgccatggctggctgatgattcattctttggcattatgcattagtgaagagagtagaatatctccagttttggctgacatctctacaacctgaacaattggcttaaacttcacttgggattcccggttgcttgttttagcatggcaaaatttggcgttcacagaatccttcttctggctatttctctgacaaagtgtctggagagtacaaaactgctggcagaccttaaaaaatgtggtgacttggaatgtgaagctttaataaacagagtctcagccatgagagattatagaggacctgactgccgatacctgaacttcactaagggagaagagatatctgtttatgttaaacttgcaggagaaagggaagatttgtgggcaggaagtaaaggaaaggagtttggatattttccca

SEQ ID NO: 152620 - DNA, 8142 bp, Homo sapiens
  Payload ID: 10034
  Gene Symbol: MIA3
  Gene Name: melanoma inhibitory activity family, member 3
  Uniprot ID: Q5JRA6
  ENST ID: ENST00000344922
  CDS Start-End: 26-5749
accggctccccgaggtgaccacaacatggctgcggcgcctgggctgctcgtctggctgctcgtgctccggctgccctggcgggtgccgggccagctggaccccagcactggccggcggttctcggagcacaaactctgcgcggacgacgaatgcagcatgttaatgtaccgcggtgaggctcttgaagatttcacaggcccggattgtcgttttgtgaattttaaaaaaggtgatcctgtatatgtttactataaactggcaagaggatggcctgaagtttgggctggaagtgttggacgcacttttggatattttccaaaagatttaatccaggtagttcatgaatataccaaagaagagctacaagttccaacagatgagacggattttgtttgttttgatggaggaagagatgattttcataattataatgtagaagaacttttagggtttttggaactgtacaattctgcagctacagattctgagaaagctgtagaaaaaactttacaggatatggaaaaaaaccctgaattatctaaggaaagggaacctgaacctgaaccagtagaagccaactcagaggaaagtgatagtgtattctcagaaaacactgaggatcttcaggaacagtttacaactcagaagcaccactcccatgcaaacagccaagcaaatcatgctcagggagagcaggcttcatttgaatcttttgaagaaatgctgcaagataaactaaaagtgccagaaagtgaaaacaacaaaaccagcaatagttctcaggtctcaaatgaacaggataagattgatgcctataaacttttgaaaaaagaaatgactctagacttgaaaaccaaatttggctcaacagctgatgcacttgtatctgatgatgagacaaccagactcgttacttcattagaagatgattttgatgaggaattggatactgagtattatgcagttggaaaggaagatgaggagaaccaagaagactttgatgagttgccattacttacctttacagatggggaagatatgaaaactccagcaaagtctggcgttgagaaatatccaacagataaagagcagaattcaaatgaagaggacaaggttcagctaactgtgccccctggcatcaaaaatgatgataaaaatatactaacaacctggggggacactatcttctctattgtcacaggaggtgaagaaacaagagatacgatggatttagagagctctagttcagaggaagaaaaagaagatgatgatgatgcattagtcccagatagcaaacaggggaaaccacagtcagcaacagattatagtgaccctgacaatgtagatgatggtctttttattgtagacattcctaaaacaaataatgacaaagaagtaaacgcagaacatcacattaaaggaaaagggaggggagttcaggaatccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagcgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgagaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatatttcccaagtgtctgttgactcattggactgttatgaggcttgtgccatttggggaacatgtaaactcaggctcccagaactgaagatggtggctggtggcacacttccggctgctcctccgtcacctgtgaactctacaagtgacgtctttttatttcaaagaagtttatttcccacttgtatagcattcacatgctttctttacgatcctcattgtctatttgagaatggttttctgagagtgagtttacattagtagcaagagttgtttgacctgatgttccattgtttttaccattcctgtagaaaaagggtgcacaacagaaaaatgaaaatgatgtgtcatggccataaaagtatagaaatctttaaaaattttaaaatgtacagtcccttatctatctttcccattccttgccactgatttttgaggaatataataaaaagattggaagagtataatgccatgagaaagaatgatttaggactgtgagggttataacatgccctaggtcagcaaccaagggttgaaatcagttctgttttagggggaaatgggggcgacagatattattccaaaattaatattaattaatatttaaacgttggtgtttttatttaaaaatcagtaactaaccatctggaattgcaccatacttaaagtcttatccattactacactgtctttaaaacaatgtttctttaaatactctacaacgtttctaagaacgaacttcagacattttaattacagtaataatagcactccttttaaggagtttcagatccacactaaaactaaaatcataaaaggctgatacttttgtttgctgctaggctatattcttccattctttgaagtcctatgatgtaatatttttgaaacctagtgtatgtcttgtcactgttgtgatatttaatcgattaagaataccttgtaaaaaggagcaaaagcttcaatgtgaaacaattttctctctttatactaaacaactgaagatagatagtttagaaagataaggacctttgaaagaagacaactctgtcaaagttcataaggaatataaaaattcttcaggaaaagagaattcaatctatatgtcctcccgtttaatatcaagaatagaagaaattaagaggaaaactccacagaagagcataggccacttttagccatgtaaaaataagattaagtcacaaatacaacttttgaatttacctgtcaatatctctttaggacacaaaacaatgctgaagttaatataatttctaattttaaatgtcatttaagtgtagattatgccatctaggaaggtaagtaggaaaggtaaattaaatctatttttaaaattcaaaatattagagtatttttcccctctaaagccttttttggtgattattctgtatctgacataattgagaaactggtaagctgtaaagattccagtgtagcttctctgagaagttgtgagccagtccataactgcttcctcacatccatctgattgcaccatttctgcagcaaaccccaaagcagggtgccaatatgcagatggcatagggagtatcatccctcagccaaatcacttttccatctctaaagtttcatctattttggaagtcatctccaactaattgtgtctggatttagttgctaaaattgtcttatttatgaagcagcaatattcagcctgaaagcatttctgccatagttgttgtagttatatcgccaatggctgatttttttcattggaaagtaaatttaagtaattcgtgggatgtggtatattctgtgtcaacttcaagataatcactcattttctcgttatattcaggtctgaattaaagttaagttaatcacacagtg

SEQ ID NO: 152621 - DNA, 2026 bp, Homo sapiens
  Payload ID: 10034
  Gene Symbol: MIA3
  Gene Name: melanoma inhibitory activity family, member 3
  Uniprot ID: Q5JRA6
  ENST ID: ENST00000344507
  CDS Start-End: 4-1506
aacatggctgcggcgcctgggctgctcgtctggctgctcgtgctccggctgccctggcgggtgccgggccagctggaccccagcactggccggcggttctcggagcacaaactctgcgcggacgacgaatgcagcatgttaatgtaccgcggtgaggctcttgaagatttcacaggcccggattgtcgttttgtgaattttaaaaaaggtgatcctgtatatgtttactataaactggcaagaggatggcctgaagtttgggctggaagtgttggacgcacttttggatattttccaaaagatttaatccaggtagttcatgaatataccaaagaagagctacaagttccaacagatgagacggattttgtttgttttgatggaggaagagatgattttcataattataatgtagaagaacttttagggtttttggaactgtacaattctgcagctacagattctgagaaagctgtagaaaaaactttacaggatatggaaaaaaaccctgaattatctaaggaaagggaacctgaacctgaaccagtagaagccaactcagaggaaagtgatagtgtattctcagaaaacactgaggatcttcaggaacagtttacaactcagaagcaccactcccatgcaaacagccaagcaaatcatgctcagggagagcaggcttcatttgaatcttttgaagaaatgctgcaagataaactaaaagtgccagaaagtgaaaacaacaaaaccagcaatagttctcaggtctcaaatgaacaggataagattgatgcctataaacttttgaaaaaagaaatgactctagacttgaaaaccaaatttggctcaacagctgatgcacttgtatctgatgatgagacaaccagactcgttacttcattagaagatgattttgatgaggaattggatactgagtattatgcagttggaaaggaagatgaggagaaccaagaagactttgatgagttgccattacttacctttacagatggggaagatatgaaaactccagcaaagtctggcgttgagaaatatccaacagataaagagcagaattcaaatgaagaggacaaggttcagctaactgtgccccctggcatcaaaaatgatgataaaaatatactaacaacctggggggacactatcttctctattgtcacaggaggtgaagaaacaagagatacgatggatttagagagctctagttcagaggaagaaaaagaagatgatgatgatgcattagtcccagatagcaaacaggggaaaccacagtcagcaacagattatagtgaccctgacaatgtagatgatggtctttttattgtagacattcctaaaacaaataatgacaaagaagtaaacgcagaacatcacattaaaggaaaagggaggggagttcaggaatccaagaggggcctggtacaagataagacagaattagaggatgaaaatcaagaaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctagagcgtccttacaactttgaaatgtgcaataaagaatacctgtgttttagctaatgtagcatatgtaattgcaaaatgatttagaatgtcatgaaaaatatgaacatttcctgtggaaatgctttaagaacatgtatttccattatcctatttttagtgtacaccagctgaatacggagcaatggtgtttataagcgtttttttaaactatctggtcacaaagactgttacgctaaaaatgtttactaaaagatcactaaactatctcccctcttgctgaagttctttgtagtaatagctcataaaaatttgtttattaatattt

SEQ ID NO: 152622 - DNA, 2735 bp, Homo sapiens
  Payload ID: 10034
  Gene Symbol: MIA3
  Gene Name: melanoma inhibitory activity family, member 3
  Uniprot ID: Q5JRA6
  ENST ID: ENST00000340535
  CDS Start-End: 174-2531
gacgtgttttataggcggcataaagcgaaagtgcaggcagctgtggaaggcgaagttcaatcccagagtccgccccctgaattggggcctttccggaggaggaagctctgaaaaacagggggcccagtgccattccgcagggaattgtcgcttgcgttcagctgttctacacaatggactcagtacctgccactgtgccttctatcgccgctaccccgggggacccggaacttgtgggacccttgtctgtgctctacgcagccttcatagccaagctgctggagctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgatatcagaaaacaagaaatctatagagaagttaaaggatgttatttcaatgaatgcctcagaattttcagaggttcagattgcacttaatgaagctaagcttagtgaagagaaggtgaagtctgaatgccatcgggttcaagaagaaaatgctaggcttaagaagaaaaaagagcagttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggtaaagaaattggaagatgaccgcaactcactacaagctgccaaagctggactggaagatgaatgcaaaaccttgaggcagaaagtggagattctgaatgagctctatcagcagaaggagatggctttgcaaaagaaactgagtcaagaagagtatgaacggcaagaaagagagcacaggctgtcagctgcagatgaaaaggcagtttcggctgcagaggaagtaaaaacttacaagcggagaattgaagaaatggaggatgaattacagaagacagagcggtcatttaaaaaccagatcgctacccatgagaagaaagctcatgaaaactggctcaaagctcgtgctgcagaaagagctatagctgaagagaaaagggaagctgccaatttgagacacaaattattagaattaacacaaaagatggcaatgctgcaagaagaacctgtgattgtaaaaccaatgccaggaaaaccaaatacacaaaaccctccacggagaggtcctctgagccagaatggctcttttggcccatcccctgtgagtggtggagaatgctcccctccattgacagtggagccacccgtgagacctctctctgctactctcaatcgaagagatatgcctagaagtgaatttggatcagtggacgggcctctacctcatcctcgatggtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataaaactatgacctctgaggtttcattggaaagaaagtgtactgtgcattatccattacagtaaaggatttcattggcttcaaaatccaaaagtttattttaaaaggtttgttgttagaactaagctgccttggcagtgtgcatttttgagccaaacaattcaaaaatgtcatttcttccctaaataaaaatcaccttttaagctag

SEQ ID NO: 152623 - DNA, 3045 bp, Homo sapiens
  Payload ID: 10034
  Gene Symbol: MIA3
  Gene Name: melanoma inhibitory activity family, member 3
  ENST ID: ENST00000354906
  CDS Start-End: 1-3045
attagtcccagatagcaaacaggggaaaccacagtcagcaacagattatagtgaccctgacaatgtagatgatggtctttttattgtagacattcctaaaacaaataatgacaaagaagtaaacgcagaacatcacattaaaggaaaagggaggggagttcaggaatccaagaggggcctggtacaagataagacagaattagaggatgaaaatcaagaaggcatgactgtgcacagttctgttcacagcaataacctcaactctatgccagctgctgaaaagggtaaagacacattaaaatcagcttatgatgatacagaaaatgacctaaaaggagcagctattcatatctcaaaaggaatgctccacgaagaaaagcctggagagcagattttggaaggtggctcagagagtgaatctgcacagaaagctgcagggaatcaaatgaatgacagaaagattcaacaggaatccctgggtagtgcaccactcatgggagatgaccaccctaacgcatccagagacagtgtggagggagacgctttggtaaatggggccaaactgcacacgctttcagtggagcatcaacgtgaggaattgaaagaggaattagttcttaaaactcaaaaccaacctagattctcctctccagatgagattgatttgcccagagaactggaagacgaggttcccattctgggaagaaatcttccctggcaacaagaaagagatgtggctgccacagccagtaagcaaatgagtgagaagataaggctctctgagggagaagccaaagaggactccttggatgaagagttttttcatcacaaggcaatgcagggcacagaggtaggacagacagaccaaactgacagcacaggaggaccagctttcctttctaaagtagaagaggatgattatccctctgaagaactactagaggatgaaaacgctataaatgcaaaacggtctaaagaaaaaaaccctgggaatcagggcaggcagtttgatgttaatctgcaagtccctgacagagcagttttagggaccattcatccagatccagaaattgaagaaagcaagcaagaaactagtatgattttggatagcgaaaaaacaagtgagactgctgccaaaggggtcaacacaggaggcagggaaccaaatacaatggtggaaaaagaacgccctctggcagataagaaagcacagagaccatttgaacgaagtgacttttctgacagcataaaaattcagactccagaattaggtgaagtgtttcagaataaagattctgattatctgaagaacgacaaccctgaggaacatctgaagacctcagggcttgcaggggagcctgagggagaactctcaaaagaggaccatgagaacacagagaagtacatgggcacagaaagccaggggtctgctgctgcagaacctgaagatgactcgttccactggactccacatacaagtgtagagccagggcatagtgacaagagggaggacttacttatcataagcagcttctttaaagaacaacagtctttgcagcggttccagaagtactttaatgtccatgagctggaagccttgctacaagaaatgtcatcaaaactgaagtcagcgcagcaggagagcctgccctataatatggaaaaagtcctagataaggtcttccgtgcttctgagtcacaaattctgagcatagcagaaaaaatgcttgatactcgtgtggctgaaaatagagatctgggaatgaacgaaaataacatatttgaagaggctgcagtgcttgatgacattcaagacctcatctattttgtcaggtacaagcactccacagcagaggagacagccacactggtgatggcaccacctctagaggaaggcttgggtggagcaatggaagagatgcaaccactgcatgaagataatttctcacgagagaagacagcagaacttaatgtgcaggttcctgaagaacccacccacttggaccaacgtgtgattggggacactcatgcctcagaagtgtcacagaagccaaatactgagaaagacctggacccagggccagttacaacagaagacactcctatggatgctattgatgcaaacaagcaaccagagacagccgccgaagagccggcaagtgtcacacctttggaaaacgcaatccttctaatatattcattcatgttttatttaactaagtcgctagttgctacattgcctgatgatgttcagcctgggcctgatttttatggactgccatggaaacctgtatttatcactgccttcttgggaattgcttcgtttgccattttcttatggagaactgtccttgttgtgaaggatagagtatatcaagtcacggaacagcaaatttctgagaagttgaagactatcatgaaagaaaatacagaacttgtacaaaaattgtcaaattatgaacagaagatcaaggaatcaaagaaacatgttcaggaaaccaggaaacaaaatatgattctctctgatgaagcaattaaatataaggataaaatcaagacacttgaaaaaaatcaggaaattctggatgacacagctaaaaatcttcgtgttatgctagaatctgagagagaacagaatgtcaagaatcaggacttgttgcagcaggaaatcgaagactggagtaaattacatgctgagctcagtgagcaaatcaaatcatttgagaagtctcagaaagatttggaagtagctcttactcacaaggatgataatattaatgctttgactaactgcattacacagttgaatctgttagagtgtgaatctgaatctgagggtcaaaataaaggtggaaatgattcagatgaattagcaaatggagaagtgggaggtgaccggaatgagaagatgaaaaatcaaattaagcagatgatggatgtctctcggacacagactgcaatatcggtagttgaagaggatctaaagcttttacagcttaagctaagagcctccgtgtccactaaatgtaacctggaagaccaggt

SEQ ID NO: 152624 - DNA, 605 bp, Homo sapiens
  Payload ID: 10034
  Gene Symbol: MIA3
  Gene Name: melanoma inhibitory activity family, member 3
  ENST ID: ENST00000450260
  CDS Start-End: 1-322
gtcagctgaggcatctgggaaaccctctccttctgatccaggatctggtacagctaccatgatgaacagcagctcaagaggctcttcccctaccagggtactcgatgaaggcaaggttaatatggctccaaaagggccccctcctttcccaggagtccctctcatgagcacccccatgggaggccctgtaccaccacccattcgatatggaccaccacctcagctctgcggaccttttgggcctcggccacttcctccaccctttgataaagatggcaggccaggcacagtggctcacgcctgtaatcccagcactttatgaatcccagcattcattagacgaggctgaggcaggtggatcccttgagcctaggagtttgagaccagcctgggcaacatggtgaaacccccatctctacaaaaaatccaaaaattagctgggagtggtggcgtgcacctgtagtcccagctactggggagtctgaggtgggaggattgattgagtccgggagattgaggctgcagtgagccatgatcactcattacactccagcccatgtgacaggcaagaccctgccgccaaaaaaaaaaaaaaaaaaaaaaaa

SEQ ID NO: 152625 - DNA, 3823 bp, Homo sapiens
  Payload ID: 10035
  Gene Symbol: MLPH
  Gene Name: melanophilin
  Uniprot ID: Q9BV36
  ENST ID: ENST00000264605
  CDS Start-End: 295-2097
atccagaggtgtccgcgctcccggagctgggcggagcggggcgcagcccacgtggttcgggcgggaggcgccgggacgtggccagttgcccgcctgccccggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagccatatgtgtattcttgatggtctatatcggggtgtgagcagatgtttgcgtatttcttgtgggtgtgactggatattagacatccggacaagtgactgaactaatgatctgctgaataatgaaggaggaatagacaccccagtccccaccctacgtgcacccgctctgcaagttcccatgtgatctgtagaccaggggaaattacactgcggtcaagggcagagcctgcacatgacagcaagtgagcatttgatagatgctcagatgctagtgcagagagcctgctgggagacgaagagacagcaggcagagctccagatgggcaaggaagaggcttggttctagcctggctctgcccctcactgcagtggatccagtggggcagaggacagagggtcacaaccaatgagggatgtctgccaaggatgggggtgcagaggccacaggagtcagcttgccactcgcccattggttacatagatgatctctcagacaggctgggactcagagttatttcctagtatcggtgtgccccatccagttttaagtggagccctccaagactctccagagctgcctttgaacatcctaacagtaatcacatctcaccctccctgaggttcactttagacaggacccaatggctgcactgcctttgtcagagggggtgctgagaggagtggcttcttttagaatcaaacagtagagacaagagtcaagccttgtgtcttcaagcattgaccaagttaagtgtttccttccctctctcaataagacacttccaggagctttccaatctctcacttaaaactaaggtttgaatctcaaagtgttgctgggaggctgatactcctgcaacttcaggagacctgtgagcacacattagcagctgtttctctgactccttgtggcatcagataaaaacgtgggagtttttccatataattcccagccttacttataaattctattctttgaaaaaattattcaggctaggtaaggtggctcatacctataatcccagccctttgagaggccaaggtgggagaattgcttgaggccaggagtttgagacctcctgggcaacatagtgagatcccatctctacaaaaaacaaaacaaaaaaattacccaagcatgatggtatatgcctgtagtcgtacctacttacttaggaggctgaggcaggaggatcacttgagccctggaggttggggctgcagtgagccatgatcgcatcactatactcgagcctgggcaacagagtgagaccttgtctcttaaaaaaattaataataaataaatgaaaataattcttcaga

SEQ ID NO: 152626 - DNA, 2332 bp, Homo sapiens
  Payload ID: 10035
  Gene Symbol: MLPH
  Gene Name: melanophilin
  Uniprot ID: Q9BV36
  ENST ID: ENST00000338530
  CDS Start-End: 212-1930
agttgcccgcctgccccggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcacca

SEQ ID NO: 152627 - DNA, 2171 bp, Homo sapiens
  Payload ID: 10035
  Gene Symbol: MLPH
  Gene Name: melanophilin
  Uniprot ID: Q9BV36
  ENST ID: ENST00000410032
  CDS Start-End: 394-1767
attggaattcggaaggacaggcaggccgggcggactggagacggcggctcgccttgggaccctctgagcttgcgggccccgctgagcacccaaaggccggccctagagtccaggagaagagcgcagcggcgcggagctcccaggcgttccccgcagcgcgtcctcggtcctggaaccaccgcgccgcgcgtcctggcttccacatctgccccatttgcccgcggatcttgactttttcttggcgggcaaggcctcggtctcctccccgcagcagggctgcccgcggctgcgggaccctcctggtcctgatgcctggcagaatcgaaggggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccagc

SEQ ID NO: 152628 - DNA, 2031 bp, Homo sapiens
  Payload ID: 10035
  Gene Symbol: MLPH
  Gene Name: melanophilin
  Uniprot ID: Q9BV36
  ENST ID: ENST00000409373
  CDS Start-End: 187-1629
aggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaatccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcacca

SEQ ID NO: 152629 - DNA, 863 bp, Homo sapiens
  Payload ID: 10035
  Gene Symbol: MLPH
  Gene Name: melanophilin
  ENST ID: ENST00000432475
  CDS Start-End: 1-598
gtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgatgaaggagtggccccaaccaatgtgatcagtcgcaggaggcaaccaatcagaggctgaagggaagttacaaagttacacatgaagacttggccgatgaccagtctggttggttgcgggaggggaccaatccgagaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccc

SEQ ID NO: 152630 - DNA, 726 bp, Homo sapiens
  Payload ID: 10035
  Gene Symbol: MLPH
  Gene Name: melanophilin
  ENST ID: ENST00000434770
  CDS Start-End: 1-438
gtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggca

SEQ ID NO: 152631 - DNA, 565 bp, Homo sapiens
  Payload ID: 10035
  Gene Symbol: MLPH
  Gene Name: melanophilin
  ENST ID: ENST00000429898
  CDS Start-End: 355-565
cattggaattcggaaggacaggcaggccgggcggactggagacggcggctcgccttgggaccctctgagcttgcgggccccgctgagcacccaaaggccggccctagagtccaggagaagagcgcagcggcgcggagctcccaggcgttccccgcagcgcgtcctcggtcctggaaccaccgcgccgcgcgtcctggcttccacatctgccccatttgcccgcggatcttgactttttcttggcgggcaaggcctcggtctcctccccgcagcagggctgcccgcggctgcgggaccctcctggtcctgatgcctggcagaatcgaaggggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccct

SEQ ID NO: 152632 - DNA, 610 bp, Homo sapiens
  Payload ID: 10035
  Gene Symbol: MLPH
  Gene Name: melanophilin
  ENST ID: ENST00000436965
  CDS Start-End: 1-610
ccagacacggcgccctggctgagctctgcccgcctggaggctcccacaggatggccctggggactgctgctgcactcgctttcaggttttcactgcaagtaattcaaacccactctcgctctgaagggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggt

SEQ ID NO: 152633 - DNA, 744 bp, Homo sapiens
  Payload ID: 10035
  Gene Symbol: MLPH
  Gene Name: melanophilin
  ENST ID: ENST00000422695
  CDS Start-End: 351-744
attgattcacaacacccttatgtgtaactcccattactattctcatcatggagaagagagaaaaaagtcagtagaagattcagtaacaggtccaagatgacacagcttgtgggccacactcctagttggaattccgactcttgcagttggtttgagcccacatgcttaacctcacacacacacacaccattcagaaagaatatagaagacaccattaataatgattgctttctggtcatggagataggaaaactgaattgcaaaagcggttcctggagaacagaatgtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggt

SEQ ID NO: 152634 - DNA, 841 bp, Homo sapiens
  Payload ID: 10035
  Gene Symbol: MLPH
  Gene Name: melanophilin
  ENST ID: ENST00000415753
  CDS Start-End: 1-709
ctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctc

SEQ ID NO: 152635 - DNA, 1447 bp, Homo sapiens
  Payload ID: 10035
  Gene Symbol: MLPH
  Gene Name: melanophilin
  ENST ID: ENST00000437893
  CDS Start-End: 1-1083
acttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcat

SEQ ID NO: 152636 - DNA, 1314 bp, Homo sapiens
  Payload ID: 10036
  Gene Symbol: MREG
  Gene Name: melanoregulin
  Uniprot ID: Q8N565
  ENST ID: ENST00000263268
  CDS Start-End: 297-941
cggggcgtctcgtggacgcatgcgccccaaattgcgctcggggaattaaaagaggggaaaaaaagcccgaagaaaactcacgccccaaacaaaacgcaaggagaggagggcgcgcggcctgcagccctcgcccgcgtccccggccgcggcgtgatgcgcgcggaccagcccgcgacgcccgggctgccgctgtccccgcacctggacgctggcgcggtggccgcgccccagcctcgatcgctcgccgcggcgactcggccccaggcttccggcgccggtgggggccctcgctctccatggggctgagggactggctgagaaccgtgtgctgctgctgcgggtgcgagtgcttggaggagcgcgccctgcctgagaaggagcccctcgtcagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttgtggaccgtctcattgcacttgatgctgcagaagagttctttaagcttgctcgtcgaacttaccccaagaagcctggggttccatgcctggcagatggccagaaagaactgcactaccttccgtttccaagtccctaaaggagaggctcaggggcagaatgggaattcttccatgaggactcagcagtcaaccaaagttggacaattacatgtagaagagagtgagcaaatagagtttgcttagtgaaaaatgatactgaattctacataaatgtaaagtctttaatctgaggaccctgccccatgaattgtgcaggctgcattgaaacgccttggtgatctcatatttaggaagaaagttaaagagttggtcagatggatagttcataatgggtggttccattctgagagcccattgccccagctttggttttagttgtgtcataatctctgatcattaatcctactgactgagtggactatttcagttaataaaacaatatgattaata

SEQ ID NO: 152637 - DNA, 584 bp, Homo sapiens
  Payload ID: 10036
  Gene Symbol: MREG
  Gene Name: melanoregulin
  ENST ID: ENST00000420348
  CDS Start-End: 239-584
agtgccttcttaggattcaagacctggttgcaaagcttcaacttgagctttagttttttgctttggtatttcttctgcactccttgtttacaaggatttcatttcagcaaagaaggcatctattgaaataagaccaaccagcaggaagattctaaaccgtattcaagaaagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttg

SEQ ID NO: 152638 - DNA, 576 bp, Homo sapiens
  Payload ID: 10036
  Gene Symbol: MREG
  Gene Name: melanoregulin
  ENST ID: ENST00000439791
  CDS Start-End: 190-576
agtctagtgagaggcagtcctgcgttctgcctggtgggagtcagagtcttaagatttgccaagtcctgatgccatcagcattcacattgccttacagaggtctcctccccactccaagatagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttgtggaccgtctcattgcacttgatgctgcagaagagttcttt

SEQ ID NO: 152639 - DNA, 560 bp, Homo sapiens
  Payload ID: 10036
  Gene Symbol: MREG
  Gene Name: melanoregulin
  ENST ID: ENST00000424992
  CDS Start-End: 203-560
ttcaacttgagctttagtttcttcctttggtatttcttctgcactccttgtttacaaggatttcatttcagcaaaggagccatctattgaaataagatcaaccagcgggaagattctaaaccatattcaggaaagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttgtggaccgtctca

SEQ ID NO: 152640 - DNA, 2618 bp, Homo sapiens
  Payload ID: 10036
  Gene Symbol: MREG
  Gene Name: melanoregulin
  Uniprot ID: Q8N565
  ENST ID: ENST00000620139
  CDS Start-End: 287-931
cgtggacgcatgcgccccaaattgcgctcggggaattaaaagaggggaaaaaaagcccgaagaaaactcacgccccaaacaaaacgcaaggagaggagggcgcgcggcctgcagccctcgcccgcgtccccggccgcggcgtgatgcgcgcggaccagcccgcgacgcccgggctgccgctgtccccgcacctggacgctggcgcggtggccgcgccccagcctcgatcgctcgccgcggcgactcggccccaggcttccggcgccggtgggggccctcgctctccatggggctgagggactggctgagaaccgtgtgctgctgctgcgggtgcgagtgcttggaggagcgcgccctgcctgagaaggagcccctcgtcagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttgtggaccgtctcattgcacttgatgctgcagaagagttctttaagcttgctcgtcgaacttaccccaagaagcctggggttccatgcctggcagatggccagaaagaactgcactaccttccgtttccaagtccctaaaggagaggctcaggggcagaatgggaattcttccatgaggactcagcagtcaaccaaagttggacaattacatgtagaagagagtgagcaaatagagtttgcttagtgaaaaatgatactgaattctacataaatgtaaagtctttaatctgaggaccctgccccatgaattgtgcaggctgcattgaaacgccttggtgatctcatatttaggaagaaagttaaagagttggtcagatggatagttcataatgggtggttccattctgagagcccattgccccagctttggttttagttgtgtcataatctctgatcattaatcctactgactgagtggactatttcagttaataaaacaatatgattaatagagagagctgtcattgagtcccaaaatggattgccagttttaaaataattattataaaatgtatgctaaccccaaaataatactaggcatgaggtgacctctctgatttggtcaccttgtagaaccttggagggtgtcagggcatctctttgagtatcagttatgattattcagaagtatagatgtatcaaatgatagaaatgacaaggaatggctgggcgtggtggctcatgcctgtaatcccagcactttgggaggccaaggtgggtggatcatgaggtcaggagttcaagaccagcctgaccaacatggtgaaaccctgtctctactaaaaatacaaaaattagccaggtgtgatggcacgcgcttgtaatcccagcctctggagtagctggaactacaggcgcgtgccaccacacctggctaattttttgtatttttagtagagacggggtttcaccatgttagccacgatggtctcgatctcctgacctcgtcatccgcctgccccagcctcccaaagtgctgggattacaggcgtgagtcaccgcgcccggccaagcccttggcattttatctggaatagcatctgtaaactgaagtgtttgacctctgttttcttctctcctctttcatctgtttctgattcgttggctggcagctgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaaaaatggaaatatttttatttttacagattttgcacttctgaattcaggttaaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaacagtgaaacaaacaataaaataaataaacct

SEQ ID NO: 152641 - DNA, 1289 bp, Homo sapiens
  Payload ID: 10037
  Gene Symbol: MTNR1A
  Gene Name: melatonin receptor 1A
  Uniprot ID: P48039
  ENST ID: ENST00000307161
  CDS Start-End: 203-1255
gggaatccaagcgggctcgcggcggacaccaggtgtcacctggccgtggcgtccggcgcggcgtgggcgtccgggggcgcggcgtggaggagcgcgcgggatggggcgtgggcgcggggagcgccgggcggagccttaacaagtggtcgggcgggcggacgaggcgggcgatggccccgcggccgggacgcgcacagggaccatgcagggcaacggcagcgcgctgcccaacgcctcccagcccgtgctccgcggggacggcgcgcggccctcgtggctggcgtccgccctggcctgcgtcctcatcttcaccatcgtggtggacatcctgggcaacctcctggtcatcctgtcggtgtatcggaacaagaagctcaggaacgcaggaaacatctttgtggtgagcttagcggtggcagacctggtggtggccatttatccgtacccgttggtgctgatgtcgatatttaacaacgggtggaacctgggctatctgcactgccaagtcagtgggttcctgatgggcctgagcgtcatcggctccatattcaacatcaccggcatcgccatcaaccgctactgctacatctgccacagtctcaagtacgacaaactgtacagcagcaagaactccctctgctacgtgctcctcatatggctcctgacgctggcggccgtcctgcccaacctccgtgcagggactctccagtacgacccgaggatctactcgtgcaccttcgcccagtccgtcagctccgcctacaccatcgccgtggtggttttccacttcctcgtccccatgatcatagtcatcttctgttacctgagaatatggatcctggttctccaggtcagacagagggtgaaacctgaccgcaaacccaaactgaaaccacaggacttcaggaattttgtcaccatgtttgtggtttttgtcctttttgccatttgctgggctcctctgaacttcattggcctggccgtggcctctgaccccgccagcatggtgcctaggatcccagagtggctgtttgtggccagttactacatggcgtatttcaacagctgcctcaatgccattatatacgggctactgaaccaaaatttcaggaaggaatacaggagaattatagtctcgctctgtacagccagggtgttctttgtggacagctctaacgacgtggccgatagggttaaatggaaaccgtctccactgatgaccaacaataatgtagtaaaggtggactccgtttaaaaaagcaccacgttccgggtgagatggacacgct

SEQ ID NO: 152642 - DNA, 1565 bp, Homo sapiens
  Payload ID: 10038
  Gene Symbol: MTNR1B
  Gene Name: melatonin receptor 1B
  Uniprot ID: P49286
  ENST ID: ENST00000257068
  CDS Start-End: 7-1095
tctgcgatgtcagagaacggctccttcgccaactgctgcgaggcgggcgggtgggcagtgcgcccgggctggtcgggggctggcagcgcgcggccctccaggacccctcgacctccctgggtggctccagcgctgtccgcggtgctcatcgtcaccaccgccgtggacgtcgtgggcaacctcctggtgatcctctccgtgctcaggaaccgcaagctccggaacgcaggtaatttgttcttggtgagtctggcattggctgacctggtggtggccttctacccctacccgctaatcctcgtggccatcttctatgacggctgggccctgggggaggagcactgcaaggccagcgcctttgtgatgggcctgagcgtcatcggctctgtcttcaatatcactgccatcgccattaaccgctactgctacatctgccacagcatggcctaccaccgaatctaccggcgctggcacacccctctgcacatctgcctcatctggctcctcaccgtggtggccttgctgcccaacttctttgtggggtccctggagtacgacccacgcatctattcctgcaccttcatccagaccgccagcacccagtacacggcggcagtggtggtcatccacttcctcctccctatcgctgtcgtgtccttctgctacctgcgcatctgggtgctggtgcttcaggcccgcaggaaagccaagccagagagcaggctgtgcctgaagcccagcgacttgcggagctttctaaccatgtttgtggtgtttgtgatctttgccatctgctgggctccacttaactgcatcggcctcgctgtggccatcaacccccaagaaatggctccccagatccctgaggggctatttgtcactagctacttactggcttatttcaacagctgcctgaatgccattgtctatgggctcttgaaccaaaacttccgcagggaatacaagaggatcctcttggccctttggaacccacggcactgcattcaagatgcttccaagggcagccacgcggaggggctgcagagcccagctccacccatcattggtgtgcagcaccaggcagatgctctctagcctggatctgaggcacaccagcagcatgacaaactcatgaaatggtgggagagagtctgctgcaagggtgagaccaggcagcctgctgggccacactgtcctgttggcatcacagccccaaggctgggggaacttcatgctgggacaagcagcccatcaacgccatgggttcaggctgatccaggagatgctcacaggccacaggacctggaaaacactcttggtggtgtcttggggatttggtgcacacaagaccaaggaaaggacagaatgaggaaaggcctggggcagaagagcccaactccttctcatagctgaccctcatcctcctgccttggcctcctggctgctttctccccttccccccagcgtggcaggatctcttcctgttagcaaggatgaaagagagaggtcagtaggactggaacttggtaactgcaagggcctcaggtggggcaggtgcagagggc

SEQ ID NO: 152643 - DNA, 425 bp, Homo sapiens
  Payload ID: 10038
  Gene Symbol: MTNR1B
  Gene Name: melatonin receptor 1B
  ENST ID: ENST00000528076
  CDS Start-End: 1-340
cgggctggtcgggggctggcagcgcgcggccctccaggacccctcgacctccctgggtggctccagcgctgtccgcggtgctcatcgtcaccaccgccgtggacgtcgtgggcaacctcctggtgatcctctccgtgctcaggaaccgcaagctccggaacgcaggtttttggtgataaaccaggagctgagagaatcaaaaagaatggtaaagcccaggcccaggacatcaagcaatgtacatatttggaatgacctcatgctgtgggccctgattgtaaataaaaatgcttttgcggaaacagcaaaatttggggaagcctgtcttccacctccttgactgaaaagtctggtcagaggtgccacctggctacttcctcctcatccttctaggaccttcctctggacccctcagttctgagccc

SEQ ID NO: 152644 - DNA, 1220 bp, Homo sapiens
  Payload ID: 10038
  Gene Symbol: MTNR1B
  Gene Name: melatonin receptor 1B
  ENST ID: ENST00000532482
  CDS Start-End: 1-240
atgtcagagaacggctccttcgccaactgctgcgaggcgggcgggtgggcagtgcgcccgggctggtcgggggctggcagcgcgcggccctccaggacccctcgacctccctgggtggctccagcgctgtccgcggtgctcatcgtcaccaccgccgtggacgtcgtgggcaacctcctggtgatcctctccgtgctcaggaaccgcaagctccggaacgcagggatatcctatctgtagtgtctgttgctgcatgtggtgggttgacttcagagatagcaccagagaaaggcagacagggaggagtggaggcaaggtgggaggtagggtcagggcaccgacccaacttaaaaggtaatttgttcttggtgagtctggcattggctgacctggtggtggccttctacccctacccgctaatcctcgtggccatcttctatgacggctgggccctgggggaggagcactgcaaggccagcgcctttgtgatgggcctgagcgtcatcggctctgtcttcaatatcactgccatcgccattaaccgctactgctacatctgccacagcatggcctaccaccgaatctaccggcgctggcacacccctctgcacatctgcctcatctggctcctcaccgtggtggccttgctgcccaacttctttgtggggtccctggagtacgacccacgcatctattcctgcaccttcatccagaccgccagcacccagtacacggcggcagtggtggtcatccacttcctcctccctatcgctgtcgtgtccttctgctacctgcgcatctgggtgctggtgcttcaggcccgcaggaaagccaagccagagagcaggctgtgcctgaagcccagcgacttgcggagctttctaaccatgtttgtggtgtttgtgatctttgccatctgctgggctccacttaactgcatcggcctcgctgtggccatcaacccccaagaaatggctccccagatccctgaggggctatttgtcactagctacttactggcttatttcaacagctgcctgaatgccattgtctatgggctcttgaaccaaaacttccgcagggaatacaagaggatcctcttggccctttggaacccacggcactgcattcaagatgcttccaagggcagccacgcggaggggctgcagagcccagctccacccatcattggtgtgcagcaccaggcagatgctctctag

SEQ ID NO: 152645 - DNA, 7415 bp, Homo sapiens
  Payload ID: 10039
  Gene Symbol: MAGI1
  Gene Name: membrane associated guanylate kinase, WW and PDZ domain containing 1
  Uniprot ID: Q96QZ7
  ENST ID: ENST00000330909
  CDS Start-End: 1-3864
atgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtctcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacctatgtcaccttcacctgcgtcgggattgagcaagggtgagagagagagagaaatcaattccacgaattttggagaatgtccgattccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgcgatgatacctcctaatatcgctgcatgtatgagaaatgaaaagctcggggaggcttgcttctaccttatgggccataatcaaactacgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgcatacttttttggaaattatttgccaaatgctggcccaaagggatataaattttgtttctacgtaacctgtagaatcgtcaagaattgttcccgttttggggcaatctttttctctcctggttaaatggggctgttgatcattttctctacgtaagggaatttattgattaagtttaattaatttgatatagactgtcatgtagtgatgtagtgctatactgtagtcggaagtttttcttaaaagcaaagagcaaaaatgcaaagttttatttgtaaaagctgaggacccttggggatggattaggtttgccgatgatcctaaaagtaagcaaactgtatgacaagactactattgcaaatgaaggatatttatagctaaactgcgcagcacaaagaagttttatattgtgagttatagttggttcagaaaacagtttgtactctccctggcccaggaaggcacacagacaaaaatgtcggccacttttactcaaatacagcccaagcacagacagtcaggttcgtgatcatcaccaacatctgataaaatctcattgaaggcaatgccatcacagctttgctcaattactacgaggaagagacaacaagcatctttcgtgttgtctcgtctgattggaggctgaatagtagatggaatggggggacagtgtgcctggtgtgaggaagacgtaagatccccaatttggaaagcatgcccccctcccttttagtagaagcccatggttgccctttgccaaactggggaggaggcaatgagccttggtggaaggaacctctctgttgatatttaaagaagtgagggctgtgggtattcattgttagaaatgccaatttcactttgaaaccatagtccaagtctctaggttggtagaagggaaaggaaggaagtggtcccagtgattctaggtctggttgggaaacttctgcctcatgactctgtcctttgagtcctttggacagcagcacaaaacataacaatttttatttttaaacagacccattctttttgatcccacaggagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtggacatttataaaacaagttcctttcctggaacagacacaatatacattctgtagctaaaaaggagggaaaagtctgtgaatgctatttttattattaaagttttccatacaaagcatacattgagctgtagtaaggctgaggaagagtacaactgaataatgatgttctttttcatcaagttcctaagagctgacttggagattttattcccagggctccactgctaggattcttctcactagttctaacaaaatctgtgatgttaaatgactgatgctctcaattgtgatccagagttttaaataaatgaaatcaaggtggattttgggaatatatcctgaagttaacatcttgatgtccttcttgttgtaagatgatatttggcaatttaaaatctatgtgctacccacctgggcttgtctcaatccgtggactttttggtgtggcagtttcacctgaattccacacatcagatttgtttggaaatattgtactgtacagggactatgcattatgcagaaagatatagttttctttgaactgctgtaaccttaaattggaaactgattcttgtgagcctactttccttaatcccgccgcccccctcccccacttaatgtaaatgtcttgatgagagataatggatgagtattttgtatgatgaaatcaaacgatttaggaatttgtctccctccgttacacagttgatgcctgaaagaatgttgggggggaggactcaacaccctaattgtattttttaagtttcttttgtgaaagattttttaatgcatttttactgtaaaaatacatggaaatgtatgcattccacaaccac

SEQ ID NO: 152646 - DNA, 4389 bp, Homo sapiens
  Payload ID: 10039
  Gene Symbol: MAGI1
  Gene Name: membrane associated guanylate kinase, WW and PDZ domain containing 1
  Uniprot ID: Q96QZ7
  ENST ID: ENST00000402939
  CDS Start-End: 1-4389
atgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtctcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacttccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctga

SEQ ID NO: 152647 - DNA, 556 bp, Homo sapiens
  Payload ID: 10039
  Gene Symbol: MAGI1
  Gene Name: membrane associated guanylate kinase, WW and PDZ domain containing 1
  ENST ID: ENST00000479287
  CDS Start-End: 1-556
gaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctg

SEQ ID NO: 152648 - DNA, 4193 bp, Homo sapiens
  Payload ID: 10039
  Gene Symbol: MAGI1
  Gene Name: membrane associated guanylate kinase, WW and PDZ domain containing 1
  ENST ID: ENST00000463103
  CDS Start-End: 1-3396
gccggaggaagcctggggacaggcaggcggcggcagaggctccctgccaccggaggcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacctatgtcaccttcacctgcgtcgggattgagcaagggtgagagagagagagaaatcaattccacgaattttggagaatgtccgattccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttgcaggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatggtgggtcaaactatgaaaacattccttccttccctggcatgactccatgaatttgtctccagaacggcagcaggaaagtcttttttgtttcccctattcaccagtgtcttaccagcctctcgcaccatgtgattatttgcctcgcttgttctgaaatctctacacatttcatccttttgcttgcttacgtggactggggcatggcctaagacaagatctttatagccccctttctgataatcagagagaacgttttgtctagtccgaccaagagcgaaggaatgtttgtttgtactgtgccaaactgttcctcagatccaattgttagcacaaaatgactatatactccttttaagaagcaggaaagcaggtttcctgagtgatatgttgaggcacaattattttttcctttttggttacttggtgtctttatttaagaggcatgaaattttgagagatttgggggctttgctaacctcccttatgctctgtatacaacacttctccatcccccaactggtgtcttaccccaaatcagaccatctgagcccactactatcaaacaaacaaacaaaaactgttaatatattagccataatgtttttaaatgataaaggatgaaataaattcccagtgctcatcatgagggaaacatgtgactatacctttcctatgaggaaagccaggttatacatagagttcctttgtcatatctttagacttgatttgagtagacagcaatgatctttacatagcttagtgttctgatggcaaaatattgtatatgataataattatgtcctatttatttgagatttgtgtttaaaattaaaaaaaaaaaaaaaaa

SEQ ID NO: 152649 - DNA, 3694 bp, Homo sapiens
  Payload ID: 10039
  Gene Symbol: MAGI1
  Gene Name: membrane associated guanylate kinase, WW and PDZ domain containing 1
  ENST ID: ENST00000460329
  CDS Start-End: 1-3410
cagcgtggtgggaggcggtttcaggctcacaaagggaaggattaatcttggcgattgggctggggtttgcaggcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacctatgtcaccttcacctgcgtcgggattgagcaagggtgagagagagagagaaatcaattccacgaattttggagaatgtccgattccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatggtgggtcaaactatgaaaacattccttccttccctggcatgactccatgaatttgtctccagaacggcagcaggaaagtcttttttgtttcccctattcaccagtgtcttaccagcctctcgcaccatgtgattatttgcctcgcttgttctgaaatctctacacatttcatccttttgcttgcttacgtggactggggcatggcctaagacaagatctttatagccccctttctgataatcagagagaacgttttgtctagtccgaccaagagcgaaggaatgtttgtttgtactgtgccaaactgttcctcagatccaattgttagcacaaa

SEQ ID NO: 152650 - DNA, 4791 bp, Homo sapiens
  Payload ID: 10039
  Gene Symbol: MAGI1
  Gene Name: membrane associated guanylate kinase, WW and PDZ domain containing 1
  Uniprot ID: Q96QZ7
  ENST ID: ENST00000483466
  CDS Start-End: 243-4013
cggaatgcaaacaaagctcgcgggcgcctgtgcggggctcgcggggaagcccagaaagtttgttttatgatggcttgagtgcgcgagcgtgtgcaggggagcgaggctgccaagtttctctctcctgttttgtgatttggggagagatgtttctcccatgaacaagcggaggcttgggggctcgtgctgtggggggcacctgtctctcgttttatttttttggaggaggggtgtaactcatcatgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtctcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacctatgtcaccttcacctgcgtcgggattgagcaagggtgagagagagagagaaatcaattccacgaattttggagaatgtccgattccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttgcaggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatggtgggtcaaactatgaaaacattccttccttccctggcatgactccatgaatttgtctccagaacggcagcaggaaagtcttttttgtttcccctattcaccagtgtcttaccagcctctcgcaccatgtgattatttgcctcgcttgttctgaaatctctacacatttcatccttttgcttgcttacgtggactggggcatggcctaagacaagatctttatagccccctttctgataatcagagagaacgttttgtctagtccgaccaagagcgaaggaatgtttgtttgtactgtgccaaactgttcctcagatccaattgttagcacaaaatgactatatactccttttaagaagcaggaaagcaggtttcctgagtgatatgttgaggcacaattattttttcctttttggttacttggtgtctttatttaagaggcatgaaattttgagagatttgggggctttgctaacctcccttatgctctgtatacaacacttctccatcccccaactggtgtcttaccccaaatcagaccatctgagcccactactatcaaacaaacaaacaaaaactgttaatatattagccataatgtttttaaatgataaaggatgaaataaattcccagtgctcatcatgagggaaacatgtgactatacctttcctatgaggaaagccaggttatacatagagttcctttgtcatatctttagacttgatttgagtagacagcaatgatctttacatagcttagtgttctgatggcaaaatattgtatatgataataattatgtcctatttatttgagatttgtgtttaaaa

SEQ ID NO: 152651 - DNA, 3045 bp, Homo sapiens
  Payload ID: 10039
  Gene Symbol: MAGI1
  Gene Name: membrane associated guanylate kinase, WW and PDZ domain containing 1
  ENST ID: ENST00000472257
  CDS Start-End: 1-3045
aagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacttccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttgcaggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatggtgggtcaaactatgaaaacattccttccttccctggcatgactccatga

SEQ ID NO: 152652 - DNA, 3555 bp, Homo sapiens
  Payload ID: 10039
  Gene Symbol: MAGI1
  Gene Name: membrane associated guanylate kinase, WW and PDZ domain containing 1
  Uniprot ID: Q96QZ7
  ENST ID: ENST00000497477
  CDS Start-End: 1-3483
atgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtctcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacttccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatggtgggtcaaactatgaaaacattccttccttccctggcatgactccatgaatttgtctccagaacggcagcaggaaagtcttttttgtttcccctattcaccagtgtcttaccagcctctcg

SEQ ID NO: 152653 - DNA, 6225 bp, Homo sapiens
  Payload ID: 10039
  Gene Symbol: MAGI1
  Gene Name: membrane associated guanylate kinase, WW and PDZ domain containing 1
  ENST ID: ENST00000621418
  CDS Start-End: 611-4078
aggaggaaggctgaacaaggacctgcgacattttctcaatcagcgattccagaaggggtctcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacttccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgcatacttttttggaaattatttgccaaatgctggcccaaagggatataaattttgtttctacgtaacctgtagaatcgtcaagaattgttcccgttttggggcaatctttttctctcctggttaaatggggctgttgatcattttctctacgtaagggaatttattgattaagtttaattaatttgatatagactgtcatgtagtgatgtagtgctatactgtagtcggaagtttttcttaaaagcaaagagcaaaaatgcaaagttttatttgtaaaagctgaggacccttggggatggattaggtttgccgatgatcctaaaagtaagcaaactgtatgacaagactactattgcaaatgaaggatatttatagctaaactgcgcagcacaaagaagttttatattgtgagttatagttggttcagaaaacagtttgtactctccctggcccaggaaggcacacagacaaaaatgtcggccacttttactcaaatacagcccaagcacagacagtcaggttcgtgatcatcaccaacatctgataaaatctcattgaaggcaatgccatcacagctttgctcaattactacgaggaagagacaacaagcatctttcgtgttgtctcgtctgattggaggctgaatagtagatggaatggggggacagtgtgcctggtgtgaggaagacgtaagatccccaatttggaaagcatgcccccctcccttttagtagaagcccatggttgccctttgccaaactggggaggaggcaatgagccttggtggaaggaacctctctgttgatatttaaagaagtgagggctgtgggtattcattgttagaaatgccaatttcactttgaaaccatagtccaagtctctaggttggtagaagggaaaggaaggaagtggtcccagtgattctaggtctggttgggaaacttctgcctcatgactctgtcctttgagtcctttggacagcagcacaaaacataacaatttttatttttaaacagacccattctttttgatcccacaggagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtggacatttataaaacaagttcctttcctggaacagacacaatatacattctgtagctaaaaaggagggaaaagtctgtgaatgctatttttattattaaagttttccatacaaagcatacattgagctgta

SEQ ID NO: 152654 - DNA, 6398 bp, Homo sapiens
  Payload ID: 10039
  Gene Symbol: MAGI1
  Gene Name: membrane associated guanylate kinase, WW and PDZ domain containing 1
  ENST ID: ENST00000611645
  CDS Start-End: 611-3553
aggaggaaggctgaacaaggacctgcgacattttctcaatcagcgattccagaaggggtctcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacctatgtcaccttcacctgcgtcgggattgagcaagggtgagagagagagagaaatcaattccacgaattttggagaatgtccgattccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgcgatgatacctcctaatatcgctgcatgtatgagaaatgaaaagctcggggaggcttgcttctaccttatgggccataatcaaactacgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgcatacttttttggaaattatttgccaaatgctggcccaaagggatataaattttgtttctacgtaacctgtagaatcgtcaagaattgttcccgttttggggcaatctttttctctcctggttaaatggggctgttgatcattttctctacgtaagggaatttattgattaagtttaattaatttgatatagactgtcatgtagtgatgtagtgctatactgtagtcggaagtttttcttaaaagcaaagagcaaaaatgcaaagttttatttgtaaaagctgaggacccttggggatggattaggtttgccgatgatcctaaaagtaagcaaactgtatgacaagactactattgcaaatgaaggatatttatagctaaactgcgcagcacaaagaagttttatattgtgagttatagttggttcagaaaacagtttgtactctccctggcccaggaaggcacacagacaaaaatgtcggccacttttactcaaatacagcccaagcacagacagtcaggttcgtgatcatcaccaacatctgataaaatctcattgaaggcaatgccatcacagctttgctcaattactacgaggaagagacaacaagcatctttcgtgttgtctcgtctgattggaggctgaatagtagatggaatggggggacagtgtgcctggtgtgaggaagacgtaagatccccaatttggaaagcatgcccccctcccttttagtagaagcccatggttgccctttgccaaactggggaggaggcaatgagccttggtggaaggaacctctctgttgatatttaaagaagtgagggctgtgggtattcattgttagaaatgccaatttcactttgaaaccatagtccaagtctctaggttggtagaagggaaaggaaggaagtggtcccagtgattctaggtctggttgggaaacttctgcctcatgactctgtcctttgagtcctttggacagcagcacaaaacataacaatttttatttttaaacagacccattctttttgatcccacaggagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtggacatttataaaacaagttcctttcctggaacagacacaatatacattctgtagctaaaaaggagggaaaagtctgtgaatgctatttttattattaaagttttccatacaaagcatacattgagctgta

SEQ ID NO: 152655 - DNA, 6225 bp, Homo sapiens; identical to SEQ ID NO: 152653
  Payload ID: 10039
  Gene Symbol: MAGI1
  Gene Name: membrane associated guanylate kinase, WW and PDZ domain containing 1
  ENST ID: ENST00000635672
  CDS Start-End: 611-4078

SEQ ID NO: 152656 - DNA, 3555 bp, Homo sapiens; identical to SEQ ID NO: 152652
  Payload ID: 10039
  Gene Symbol: MAGI1
  Gene Name: membrane associated guanylate kinase, WW and PDZ domain containing 1
  ENST ID: ENST00000635471
  CDS Start-End: 1-3483

SEQ ID NO: 152657 - DNA, 4193 bp, Homo sapiens; identical to SEQ ID NO: 152648
  Payload ID: 10039
  Gene Symbol: MAGI1
  Gene Name: membrane associated guanylate kinase, WW and PDZ domain containing 1
  ENST ID: ENST00000635181
  CDS Start-End: 1-3396

SEQ ID NO: 152658 - DNA, 4791 bp, Homo sapiens; identical to SEQ ID NO: 152650
  Payload ID: 10039
  Gene Symbol: MAGI1
  Gene Name: membrane associated guanylate kinase, WW and PDZ domain containing 1
  ENST ID: ENST00000635378
  CDS Start-End: 243-4013

SEQ ID NO: 152659 - DNA, 7415 bp, Homo sapiens; identical to SEQ ID NO: 152645
  Payload ID: 10039
  Gene Symbol: MAGI1
  Gene Name: membrane associated guanylate kinase, WW and PDZ domain containing 1
  ENST ID: ENST00000634774
  CDS Start-End: 1-3864

SEQ ID NO: 152660 - DNA, 4389 bp, Homo sapiens; identical to SEQ ID NO: 152646
  Payload ID: 10039
  Gene Symbol: MAGI1
  Gene Name: membrane associated guanylate kinase, WW and PDZ domain containing 1
  ENST ID: ENST00000634409
  CDS Start-End: 1-4389

SEQ ID NO: 152661 - DNA, 556 bp, Homo sapiens; identical to SEQ ID NO: 152647
  Payload ID: 10039
  Gene Symbol: MAGI1
  Gene Name: membrane associated guanylate kinase, WW and PDZ domain containing 1
  ENST ID: ENST00000634863
  CDS Start-End: 1-556

SEQ ID NO: 152662 - DNA, 3045 bp, Homo sapiens; identical to SEQ ID NO: 152651
  Payload ID: 10039
  Gene Symbol: MAGI1
  Gene Name: membrane associated guanylate kinase, WW and PDZ domain containing 1
  ENST ID: ENST00000634578
  CDS Start-End: 1-3045

SEQ ID NO: 152663 - DNA, 6398 bp, Homo sapiens; identical to SEQ ID NO: 152654
  Payload ID: 10039
  Gene Symbol: MAGI1
  Gene Name: membrane associated guanylate kinase, WW and PDZ domain containing 1
  ENST ID: ENST00000635039
  CDS Start-End: 611-3553

SEQ ID NO: 152664 - DNA, 3694 bp, Homo sapiens; identical to SEQ ID NO: 152649
  Payload ID: 10039
  Gene Symbol: MAGI1
  Gene Name: membrane associated guanylate kinase, WW and PDZ domain containing 1
  ENST ID: ENST00000634856
  CDS Start-End: 1-3410

SEQ ID NO: 152665 - DNA, 6880 bp, Homo sapiens
  Payload ID: 10040
  Gene Symbol: MAGI2
  Gene Name: membrane associated guanylate kinase, WW and PDZ domain containing 2
  Uniprot ID: Q86UL8
  ENST ID: ENST00000354212
  CDS Start-End: 255-4622
agccttgagtgtcattcaagggacagcacaacctcatccaagctctcctacctctgcccagccgtccctctcatcctccccattcctcgtccacactccatccaaagaagagggaaagcaccgaatagaggggggcgaaggcaaagtctgctgttcttccccctgggcccccttgctcctccatcctcattctctcaccaccagcccccctaaccccaaggagcccaggaactgaggcgactcgccccactgccatgtccaaaagcttgaaaaagaaaagccactggactagcaaagtccatgagagtgtcattggcaggaacccggagggccagctgggctttgaactgaaggggggcgccgagaatggacagttcccctacctgggggaggtgaagcccggcaaggtggcctatgagagcggcagcaaattggtgtcggaggagctgctgctggaggtgaacgagacccccgtggcggggctcaccatcagggacgtgctggccgtgatcaaacactgcaaggaccccctccggctcaagtgtgtcaagcaaggaggaattgttgataaagaccttcgtcactacctcaacttacgatttcaaaagggttctgtggaccatgagcttcagcaaatcattcgtgacaacctctacctccgcacggtgccatgcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcggaagtgaaagcaaggcaagatgtgaaaccagacatccgacagcctccattcacagactacaggcagcccccgctggattacaggcaacccccaggaggggactaccagcagcccccacccttggactacaggcagcctcccctactggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacgggaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggcccgggggctgcgccggcgtttgccggcccgggcggcggcggcagcggcgcgctggaggccgagggcagggcgggtgcgcgcgcgggtccccggccgggcccgcgacccccggggggcgccccggcgcgcaaggccgccgtcgcgccggggccctggaaggtgccgggttctgacaagctgcccagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacattcggaaccgttcacccatgacatgtttccatggctcacccttggcatccatcctcggtgttagcagcagcgttccctgcctcctgcaggatgacttagaaatctagtgagtttcttggtgtgatgccatttttattgccctttctgtgatcaaatcatatttctgtacattttcagtggtagaaaaaaaaggttttaaaaattgtatcctagggaacagtttgccataagtcagaattttgcagtttagctcatagatcttaattggtttttctctaaaatatgaattttataattgaaggaccacaatttgtttaatcaagataggcaacgctgcagttcctttatgaagaggcttttctgtcgtcccaggctagcagagatggatagcttctttgtcagcaatgtgatttcacttattttattgtcttattttaaaccctgtctccatgacttcatttgcactttgacagagcagaggcagagtatttgtcttatatttctcagattataatattaaaaaattacaatcaatttattttcattaaagaacgtgagtctttttagcattcctttctgcttatccttctttccttaccctttgtccttttgtttccattagttttctttcgtcttgtattccttgccactttattttgttagcaacttctagatgtttatcttcatggatctatgattgacctcctagtaaaattctaagtcttgcctttcttccctgctgttttagcatttctttgtaaaatgttagcttcaattaattagccattggtacttactgtagctacacatattaaaaggcaaagtgtttctgaaggcaatttctttttaatatgcccgaatgaatgaggcttcatcctttccatattcttactctttacaggagttcaaatgcaaataagctccacctccctgcacttgtagtctaaaaagtaaaaggggcgatcaggtccatctcaaaggtcacacgtaatagcctccctgggctgatcattccctctccttgtaattgcagtatcctgagtagcagtttaattttcatcaaacatcggagtagtttagttgtttgacaggaggagaataaggctgaaagcctcaagtgaaggatcttgcagcttgtaaaagcaatttccaaaaatgaaacccattcatcgtaaacaaaagcacaaacacttgtagcagtttataatgcttttggtttaatctcaattagtctttctcccctggactagaaatccagtatagtttgccattaatttattgaatctggttttggacaatgcttctgtagtgtagctgcacgtcctggtactgtatcctctgactttattttccatgtattacaaaaggaaaaaaaaattgagattacactggcataaactctagtttgcacagttcacagctactacttgtgcagtaattgctttatgcggctgtaatccataacctgtgaagacagcacatcatctaaatcccattccaaataatatttgtgtagtgttagctgtgaatttaccctgtacagctgtatctctataaatataattccatgtattaatagtcacagaaagactgtaagtgagcaactatttttatgaaacgtaccactatggataaattaacttttacagaaatcttgtttactgtatgatattctaaaacactgtcaaataaaatatatatccaaaaatcttttctttttccaacta

SEQ ID NO: 152666 - DNA, 6800 bp, Homo sapiens
  Payload ID: 10040
  Gene Symbol: MAGI2
  Gene Name: membrane associated guanylate kinase, WW and PDZ domain containing 2
  Uniprot ID: Q86UL8
  ENST ID: ENST00000419488
  CDS Start-End: 236-4561
gggacagcacaacctcatccaagctctcctacctctgcccagccgtccctctcatcctccccattcctcgtccacactccatccaaagaagagggaaagcaccgaatagaggggggcgaaggcaaagtctgctgttcttccccctgggcccccttgctcctccatcctcattctctcaccaccagcccccctaaccccaaggagcccaggaactgaggcgactcgccccactgccatgtccaaaagcttgaaaaagaaaagccactggactagcaaagtccatgagagtgtcattggcaggaacccggagggccagctgggctttgaactgaaggggggcgccgagaatggacagttcccctacctgggggaggtgaagcccggcaaggtggcctatgagagcggcagcaaattggtgtcggaggagctgctgctggaggtgaacgagacccccgtggcggggctcaccatcagggacgtgctggccgtgatcaaacactgcaaggaccccctccggctcaagtgtgtcaagcaaggaggaattgttgataaagaccttcgtcactacctcaacttacgatttcaaaagggttctgtggaccatgagcttcagcaaatcattcgtgacaacctctacctccgcacggtgccatgcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcgtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcggaagtgaaagcaaggcaagatgtgaaaccagacatccgacagcctccattcacagactacaggcagcccccgctggattacaggcaacccccaggaggggactaccagcagcccccacccttggactacaggcagcctcccctactggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacgggaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggcccgggggctgcgccggcgtttgccggcccgggcggcggcggcagcggcgcgctggaggccgagggcagggcgggtgcgcgcgcgggtccccggccgggcccgcgacccccggggggcgccccggcgcgcaaggccgccgtcgcgccggggccctggaaggtgccgggttctgacaagctgcccagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacattcggaaccgttcacccatgacatgtttccatggctcacccttggcatccatcctcggtgttagcagcagcgttccctgcctcctgcaggatgacttagaaatctagtgagtttcttggtgtgatgccatttttattgccctttctgtgatcaaatcatatttctgtacattttcagtggtagaaaaaaaaggttttaaaaattgtatcctagggaacagtttgccataagtcagaattttgcagtttagctcatagatcttaattggtttttctctaaaatatgaattttataattgaaggaccacaatttgtttaatcaagataggcaacgctgcagttcctttatgaagaggcttttctgtcgtcccaggctagcagagatggatagcttctttgtcagcaatgtgatttcacttattttattgtcttattttaaaccctgtctccatgacttcatttgcactttgacagagcagaggcagagtatttgtcttatatttctcagattataatattaaaaaattacaatcaatttattttcattaaagaacgtgagtctttttagcattcctttctgcttatccttctttccttaccctttgtccttttgtttccattagttttctttcgtcttgtattccttgccactttattttgttagcaacttctagatgtttatcttcatggatctatgattgacctcctagtaaaattctaagtcttgcctttcttccctgctgttttagcatttctttgtaaaatgttagcttcaattaattagccattggtacttactgtagctacacatattaaaaggcaaagtgtttctgaaggcaatttctttttaatatgcccgaatgaatgaggcttcatcctttccatattcttactctttacaggagttcaaatgcaaataagctccacctccctgcacttgtagtctaaaaagtaaaaggggcgatcaggtccatctcaaaggtcacacgtaatagcctccctgggctgatcattccctctccttgtaattgcagtatcctgagtagcagtttaattttcatcaaacatcggagtagtttagttgtttgacaggaggagaataaggctgaaagcctcaagtgaaggatcttgcagcttgtaaaagcaatttccaaaaatgaaacccattcatcgtaaacaaaagcacaaacacttgtagcagtttataatgcttttggtttaatctcaattagtctttctcccctggactagaaatccagtatagtttgccattaatttattgaatctggttttggacaatgcttctgtagtgtagctgcacgtcctggtactgtatcctctgactttattttccatgtattacaaaaggaaaaaaaaattgagattacactggcataaactctagtttgcacagttcacagctactacttgtgcagtaattgctttatgcggctgtaatccataacctgtgaagacagcacatcatctaaatcccattccaaataatatttgtgtagtgttagctgtgaatttaccctgtacagctgtatctctataaatataattccatgtattaatagtcacagaaagactgtaagtgagcaactatttttatgaaacgtaccactatggataaattaacttttacagaaatcttgtttactgtatgatattctaaaacactgtcaaataaaatatatatccaaaaa

SEQ ID NO: 152667 - DNA, 4878 bp, Homo sapiens
  Payload ID: 10040
  Gene Symbol: MAGI2
  Gene Name: membrane associated guanylate kinase, WW and PDZ domain containing 2
  ENST ID: ENST00000522391
  CDS Start-End: 140-3991
aagcaccgaatagaggggggcgaaggcaaagtctgctgttcttccccctgggcccccttgctcctccatcctcattctctcaccaccagcccccctaaccccaaggagcccaggaactgaggcgactcgccccactgccatgtccaaaagcttgaaaaagaaaagccactggactagcaaagtccatgagagtgtcattggcaggaacccggagggccagctgggctttgaactgaaggggggcgccgagaatggacagttcccctacctgggggaggtgaagcccggcaaggtggcctatgagagcggcagcaaattggtgtcggaggagctgctgctggaggtgaacgagacccccgtggcggggctcaccatcagggacgtgctggccgtgatcaaacactgcaaggaccccctccggctcaagtgtgtcaagcaaggaggaattgttgataaagaccttcgtcactacctcaacttacgatttcaaaagggttctgtggaccatgagcttcagcaaatcattcgtgacaacctctacctccgcacggtgccatgcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcggaagtgaaagcaaggcaagatgtgaaaccagacatccgacagcctccattcacagactacaggcagcccccgctggattacaggcaacccccaggaggggactaccagcagcccccacccttggactacaggcagcctcccctactggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatggaatggtaccttccagtctctccatgtgcatgaaaagtgacaagcatgggtccccatatttctacttattgggccaccctaaagacacgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacgggaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggcccgggggctgcgccggcgtttgccggcccgggcggcggcggcagcggcgcgctggaggccgagggcagggcgggtgcgcgcgcgggtccccggccgggcccgcgacccccggggggcgccccggcgcgcaaggccgccgtcgcgccggggccctggaaggtgccgggttctgacaagctgcccagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcag

SEQ ID NO: 152668 - DNA, 6146 bp, Homo sapiens
  Payload ID: 10040
  Gene Symbol: MAGI2
  Gene Name: membrane associated guanylate kinase, WW and PDZ domain containing 2
  ENST ID: ENST00000535697
  CDS Start-End: 1-3912
tcaggcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcgtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcggaagtgaaagcaaggcaagatgtgaaaccagacatccgacagcctccattcacagactacaggcagcccccgctggattacaggcaacccccaggaggggactaccagcagcccccacccttggactacaggcagcctcccctactggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacgggaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggcccgggggctgcgccggcgtttgccggcccgggcggcggcggcagcggcgcgctggaggccgagggcagggcgggtgcgcgcgcgggtccccggccgggcccgcgacccccggggggcgccccggcgcgcaaggccgccgtcgcgccggggccctggaaggtgccgggttctgacaagctgcccagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacattcggaaccgttcacccatgacatgtttccatggctcacccttggcatccatcctcggtgttagcagcagcgttccctgcctcctgcaggatgacttagaaatctagtgagtttcttggtgtgatgccatttttattgccctttctgtgatcaaatcatatttctgtacattttcagtggtagaaaaaaaaggttttaaaaattgtatcctagggaacagtttgccataagtcagaattttgcagtttagctcatagatcttaattggtttttctctaaaatatgaattttataattgaaggaccacaatttgtttaatcaagataggcaacgctgcagttcctttatgaagaggcttttctgtcgtcccaggctagcagagatggatagcttctttgtcagcaatgtgatttcacttattttattgtcttattttaaaccctgtctccatgacttcatttgcactttgacagagcagaggcagagtatttgtcttatatttctcagattataatattaaaaaattacaatcaatttattttcattaaagaacgtgagtctttttagcattcctttctgcttatccttctttccttaccctttgtccttttgtttccattagttttctttcgtcttgtattccttgccactttattttgttagcaacttctagatgtttatcttcatggatctatgattgacctcctagtaaaattctaagtcttgcctttcttccctgctgttttagcatttctttgtaaaatgttagcttcaattaattagccattggtacttactgtagctacacatattaaaaggcaaagtgtttctgaaggcaatttctttttaatatgcccgaatgaatgaggcttcatcctttccatattcttactctttacaggagttcaaatgcaaataagctccacctccctgcacttgtagtctaaaaagtaaaaggggcgatcaggtccatctcaaaggtcacacgtaatagcctccctgggctgatcattccctctccttgtaattgcagtatcctgagtagcagtttaattttcatcaaacatcggagtagtttagttgtttgacaggaggagaataaggctgaaagcctcaagtgaaggatcttgcagcttgtaaaagcaatttccaaaaatgaaacccattcatcgtaaacaaaagcacaaacacttgtagcagtttataatgcttttggtttaatctcaattagtctttctcccctggactagaaatccagtatagtttgccattaatttattgaatctggttttggacaatgcttctgtagtgtagctgcacgtcctggtactgtatcctctgactttattttccatgtattacaaaaggaaaaaaaaattgagattacactggcataaactctagtttgcacagttcacagctactacttgtgcagtaattgctttatgcggctgtaatccataacctgtgaagacagcacatcatctaaatcccattccaaataatatttgtgtagtgttagctgtgaatttaccctgtacagctgtatctctataaatataattccatgtattaatagtcacagaaagactgtaagtgagcaactatttttatgaaacgtaccactatggataaattaacttttacagaaatcttgtttactgtatgatattctaaaacactgtcaaataaaatatatatcc

SEQ ID NO: 152669 - DNA, 2013 bp, Homo sapiens
  Payload ID: 10040
  Gene Symbol: MAGI2
  Gene Name: membrane associated guanylate kinase, WW and PDZ domain containing 2
  ENST ID: ENST00000628781
  CDS Start-End: 302-1969
aaaagagctcagcggcagttttgtgttgctgtgtctggcttaaagaggaaaattctagacatccatgttgaaaaatcaaagctcagctgagactacttctatcaagaaaattatttttatctgcgaatgggttggatcagtacaggtggtttgagaagacactgactgaggaccatggaaaggtgggagaggacgtgcggcttctctgcttcctttgaacagagctctaggcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtaagacaaacactggctcagcaataaaatatgtgggtaaaatagtaggatcatttaataatattgttaaaatgcagatttccttggagttgaatgaaattatactttaaaaaataaagcttaaagagtgagagagaaaaacatgaattaaagg

SEQ ID NO: 152670 - DNA, 4599 bp, Homo sapiens
  Payload ID: 10040
  Gene Symbol: MAGI2
  Gene Name: membrane associated guanylate kinase, WW and PDZ domain containing 2
  ENST ID: ENST00000626691
  CDS Start-End: 334-3696
ctgcatgcttcatctttgagaggagggaaaacaaaagagctcagcggcagttttgtgttgctgtgtctggcttaaagaggaaaattctagacatccatgttgaaaaatcaaagctcagctgagactacttctatcaagaaaattatttttatctgcgaatgggttggatcagtacaggtggtttgagaagacactgactgaggaccatggaaaggtgggagaggacgtgcggcttctctgcttcctttgaacagagctctaggcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcggaagtgaaagcaaggcaagatgtgaaaccagacatccgacagcctccattcacagactacaggcagcccccgctggattacaggcaacccccaggaggggactaccagcagcccccacccttggactacaggcagcctcccctactggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatggaatggtaccttccagtctctccatgtgcatgaaaagtgacaagcatgggtccccatatttctacttattgggccaccctaaagacacgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacgggaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggcccgggggctgcgccggcgtttgccggcccgggcggcggcggcagcggcgcgctggaggccgagggcagggcgggtgcgcgcgcgggtccccggccgggcccgcgacccccggggggcgccccggcgcgcaaggccgccgtcgcgccggggccctggaaggtgccgggttctgacaagctgcccagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaa

SEQ ID NO: 152671 - DNA, 715 bp, Homo sapiens
  Payload ID: 10040
  Gene Symbol: MAGI2
  Gene Name: membrane associated guanylate kinase, WW and PDZ domain containing 2
  ENST ID: ENST00000628361
  CDS Start-End: 1-715
ataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaaaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttg

SEQ ID NO: 152672 - DNA, 643 bp, Homo sapiens
  Payload ID: 10040
  Gene Symbol: MAGI2
  Gene Name: membrane associated guanylate kinase, WW and PDZ domain containing 2
  ENST ID: ENST00000522342
  CDS Start-End: 1-552
aggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataatcttccagagctcattcagcagcctgcaagcagtagaacagaagagaggataggaaaatttgtgcatttttcatgttgaagtgatttggcccaaaatgttgggtatggaaacacgaaaataaaggagcactaagagaaagtaaa

SEQ ID NO: 152673 - DNA, 3316 bp, Homo sapiens
  Payload ID: 10040
  Gene Symbol: MAGI2
  Gene Name: membrane associated guanylate kinase, WW and PDZ domain containing 2
  ENST ID: ENST00000519748
  CDS Start-End: 268-2853
aaatttacagctgccttgcacaattactcttacacctccttcagggctacttagaaccaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcggaagtgaaagcaaggcaagatgtgaaaccagacatccgacagcctccattcacagactacaggcagcccccgctggattacaggcaacccccaggaggggactaccagcagcccccacccttggactacaggcagcctcccctactggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatggtacgtttcacgttttaattcacccttttgctcttccttctgtgaaccataaatgcttatggttatttataaaactacatcagttctccacttctacctaaatatatatttagctatcaataggtatatatatacacacacacacacacacacacacatacacacacacacgtatgtttatgcccaggaaataaatgtgtgtgaactctttcttttgctccctccattaaggaatgtttaaaatatgaaatgtaggacctttcagggcatctgtgagtgtgcgaggagatctagcaccacttaaatattagaactgttacaatttgactgatagtccactgttcatttgagtacacagtaatttatcaattatttcctaacattgtttatgcatcagactatctcaaaggatttgtaactggggccagagacaagcaacatatcttcagggtgtgaagtttaaaatgtaaacttcagttcacgcaatggttgcatttctttgacatttaggaattattctgaaaattcactcctgtgttgtgtttctgtatgcttttgaggaag

SEQ ID NO: 152674 - DNA, 533 bp, Homo sapiens
  Payload ID: 10040
  Gene Symbol: MAGI2
  Gene Name: membrane associated guanylate kinase, WW and PDZ domain containing 2
  ENST ID: ENST00000524268
  CDS Start-End: 1-318
cacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataagtaagtgctgaaatttgcctgcatttgaataaggggtcttgttttgatttgttccagtgatacagataccggacaagtatatcagaagactgtcacggacatactgtatagcctgaaagccacaggctgtgggcacaaataaggcatccataccactgactagcagacagttactgacctctggctcaagaagaaggcaagaacacaactaatgccctcaactcct

SEQ ID NO: 152675 - DNA, 2349 bp, Homo sapiens
  Payload ID: 10040
  Gene Symbol: MAGI2
  Gene Name: membrane associated guanylate kinase, WW and PDZ domain containing 2
  ENST ID: ENST00000630991
  CDS Start-End: 798-2285
aaaagtgagagacaggcgcgtagataacacaggttcttgtgctgagagatgtaaatgcccctgactgaccgggaagcgagcgaggttgctggtgggggttggggaaagggaaacggagggagagagcataagcgagagaggggagaaggagagagagggagagggagagagggagaggcagagggagacagagagagagagagagaagtgctgcatgcttcatctttgagaggagggaaaacaaaagagctcagcggcagttttgtgttgctgtgtctggcttaaagaggaaaattctagacatccatgttgaaaaatcaaagctcagctgagactacttctatcaagaaaattatttttatctgcgaatgggttggatcagtacaggtggtttgagaagacactgactgaggaccatggaaaggtgggagaggacgtgcggcttctctgcttcctttgaacagagctctaggcaccacaaggccacataaggagggtgaggtccctggagtggattatattttcatcactgttgaagattttatggaattggagaaaagtggtgctctcctagaaagtgggacttatgaagacggagtctcgctctgtcgcccaggctggagtgcagtggcatgatctcggctcaccgcaacctctgcctcccagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtaagacaaacactggctcagcaataaaatatgtgggtaaaatagtaggatcatttaataatattgttaaaatgcagatttccttggagttgaatgaaattatactttaaaaaataaagcttaaagagtgagagagaaaaacatgaattaaaggaaactttgtttttgaattca

SEQ ID NO: 152676 - DNA, 6704 bp, Homo sapiens
  Payload ID: 10040
  Gene Symbol: MAGI2
  Gene Name: membrane associated guanylate kinase, WW and PDZ domain containing 2
  ENST ID: ENST00000629359
  CDS Start-End: 545-3865
caaaagtgagagacaggcgcgtagataacacaggttcttgtgctgagagatgtaaatgcccctgactgaccgggaagcgagcgaggttgctggtgggggttggggaaagggaaacggagggagagagcataagcgagagaggggagaaggagagagagggagagggagagagggagaggcagagggagacagagagagagagagagaagtgctgcatgcttcatctttgagaggagggaaaacaaaagagctcagcggcagttttgtgttgctgtgtctggcttaaagaggaaaattctagacatccatgttgaaaaatcaaagctcagctgagactacttctatcaagaaaattatttttatctgcgaatgggttggatcagtacaggtggtttgagaagacactgactgaggaccatggaaaggtgggagaggacgtgcggcttctctgcttcctttgaacagagctctaggcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcgtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcggaagtgaaagcaaggcaagatgtgaaaccagacatccgacagcctccattcacagactacaggcagcccccgctggattacaggcaacccccaggaggggactaccagcagcccccacccttggactacaggcagcctcccctactggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatggaatggtaccttccagtctctccatgtgcatgaaaagtgacaagcatgggtccccatatttctacttattgggccaccctaaagacacgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacgggaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggcccgggggctgcgccggcgtttgccggcccgggcggcggcggcagcggcgcgctggaggccgagggcagggcgggtgcgcgcgcgggtccccggccgggcccgcgacccccggggggcgccccggcgcgcaaggccgccgtcgcgccggggccctggaaggtgccgggttctgacaagctgcccagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacattcggaaccgttcacccatgacatgtttccatggctcacccttggcatccatcctcggtgttagcagcagcgttccctgcctcctgcaggatgacttagaaatctagtgagtttcttggtgtgatgccatttttattgccctttctgtgatcaaatcatatttctgtacattttcagtggtagaaaaaaaaggttttaaaaattgtatcctagggaacagtttgccataagtcagaattttgcagtttagctcatagatcttaattggtttttctctaaaatatgaattttataattgaaggaccacaatttgtttaatcaagataggcaacgctgcagttcctttatgaagaggcttttctgtcgtcccaggctagcagagatggatagcttctttgtcagcaatgtgatttcacttattttattgtcttattttaaaccctgtctccatgacttcatttgcactttgacagagcagaggcagagtatttgtcttatatttctcagattataatattaaaaaattacaatcaatttattttcattaaagaacgtgagtctttttagcattcctttctgcttatccttctttccttaccctttgtccttttgtttccattagttttctttcgtcttgtattccttgccactttattttgttagcaacttctagatgtttatcttcatggatctatgattgacctcctagtaaaattctaagtcttgcctttcttccctgctgttttagcatttctttgtaaaatgttagcttcaattaattagccattggtacttactgtagctacacatattaaaaggcaaagtgtttctgaaggcaatttctttttaatatgcccgaatgaatgaggcttcatcctttccatattcttactctttacaggagttcaaatgcaaataagctccacctccctgcacttgtagtctaaaaagtaaaaggggcgatcaggtccatctcaaaggtcacacgtaatagcctccctgggctgatcattccctctccttgtaattgcagtatcctgagtagcagtttaattttcatcaaacatcggagtagtttagttgtttgacaggaggagaataaggctgaaagcctcaagtgaaggatcttgcagcttgtaaaagcaatttccaaaaatgaaacccattcatcgtaaacaaaagcacaaacacttgtagcagtttataatgcttttggtttaatctcaattagtctttctcccctggactagaaatccagtatagtttgccattaatttattgaatctggttttggacaatgcttctgtagtgtagctgcacgtcctggtactgtatcctctgactttattttccatgtattacaaaaggaaaaaaaaattgagattacactggcataaactctagtttgcacagttcacagctactacttgtgcagtaattgctttatgcggctgtaatccataacctgtgaagacagcacatcatctaaatcccattccaaataatatttgtgtagtgttagctgtgaatttaccctgtacagctgtatctctataaatataattccatgtattaatagtcacagaaagactgtaagtgagcaactatttttatgaaacgtaccactatggataaattaacttttacagaaatcttgtttactgtatgatattctaaaacactgtcaaataaaatatatatcc

SEQ ID NO: 152677 - DNA, 6212 bp, Homo sapiens
  Payload ID: 10040
  Gene Symbol: MAGI2
  Gene Name: membrane associated guanylate kinase, WW and PDZ domain containing 2
  ENST ID: ENST00000628980
  CDS Start-End: 1-3954
tcaggcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcggaagtgaaagcaaggcaagatgtgaaaccagacatccgacagcctccattcacagactacaggcagcccccgctggattacaggcaacccccaggaggggactaccagcagcccccacccttggactacaggcagcctcccctactggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacgggaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggcccgggggctgcgccggcgtttgccggcccgggcggcggcggcagcggcgcgctggaggccgagggcagggcgggtgcgcgcgcgggtccccggccgggcccgcgacccccggggggcgccccggcgcgcaaggccgccgtcgcgccggggccctggaaggtgccgggttctgacaagctgcccagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacattcggaaccgttcacccatgacatgtttccatggctcacccttggcatccatcctcggtgttagcagcagcgttccctgcctcctgcaggatgacttagaaatctagtgagtttcttggtgtgatgccatttttattgccctttctgtgatcaaatcatatttctgtacattttcagtggtagaaaaaaaaggttttaaaaattgtatcctagggaacagtttgccataagtcagaattttgcagtttagctcatagatcttaattggtttttctctaaaatatgaattttataattgaaggaccacaatttgtttaatcaagataggcaacgctgcagttcctttatgaagaggcttttctgtcgtcccaggctagcagagatggatagcttctttgtcagcaatgtgatttcacttattttattgtcttattttaaaccctgtctccatgacttcatttgcactttgacagagcagaggcagagtatttgtcttatatttctcagattataatattaaaaaattacaatcaatttattttcattaaagaacgtgagtctttttagcattcctttctgcttatccttctttccttaccctttgtccttttgtttccattagttttctttcgtcttgtattccttgccactttattttgttagcaacttctagatgtttatcttcatggatctatgattgacctcctagtaaaattctaagtcttgcctttcttccctgctgttttagcatttctttgtaaaatgttagcttcaattaattagccattggtacttactgtagctacacatattaaaaggcaaagtgtttctgaaggcaatttctttttaatatgcccgaatgaatgaggcttcatcctttccatattcttactctttacaggagttcaaatgcaaataagctccacctccctgcacttgtagtctaaaaagtaaaaggggcgatcaggtccatctcaaaggtcacacgtaatagcctccctgggctgatcattccctctccttgtaattgcagtatcctgagtagcagtttaattttcatcaaacatcggagtagtttagttgtttgacaggaggagaataaggctgaaagcctcaagtgaaggatcttgcagcttgtaaaagcaatttccaaaaatgaaacccattcatcgtaaacaaaagcacaaacacttgtagcagtttataatgcttttggtttaatctcaattagtctttctcccctggactagaaatccagtatagtttgccattaatttattgaatctggttttggacaatgcttctgtagtgtagctgcacgtcctggtactgtatcctctgactttattttccatgtattacaaaaggaaaaaaaaattgagattacactggcataaactctagtttgcacagttcacagctactacttgtgcagtaattgctttatgcggctgtaatccataacctgtgaagacagcacatcatctaaatcccattccaaataatatttgtgtagtgttagctgtgaatttaccctgtacagctgtatctctataaatataattccatgtattaatagtcacagaaagactgtaagtgagcaactatttttatgaaacgtaccactatggataaattaacttttacagaaatcttgtttactgtatgatattctaaaacactgtcaaataaaatatatatccaaaaatcttttctttttccaacta

SEQ ID NO: 152678 - DNA, 492 bp, Homo sapiens
  Payload ID: 10040
  Gene Symbol: MAGI2
  Gene Name: membrane associated guanylate kinase, WW and PDZ domain containing 2
  ENST ID: ENST00000634996
  CDS Start-End: 268-492
aaatttacagctgccttgcacaattactcttacacctccttcagggctacttagaaccaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagtagacagctcctcatggacattacctaggcccaaatccatccgcccccgtgctgccccggagaggtcgcgcagcgtgaatgacttgtcttactatcagcgcgacccagcagggaggccctggctgttcgaaaaaccactcttcacccgggatgcatcccagttgaagggaaca

SEQ ID NO: 152679 - DNA, 6430 bp, Homo sapiens
  Payload ID: 10041
  Gene Symbol: MAGI3
  Gene Name: membrane associated guanylate kinase, WW and PDZ domain containing 3
  Uniprot ID: Q5TCQ9
  ENST ID: ENST00000307546
  CDS Start-End: 76-4521
ccgggctgagacggggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaaaaaaaca

SEQ ID NO: 152680 - DNA, 3596 bp, Homo sapiens
  Payload ID: 10041
  Gene Symbol: MAGI3
  Gene Name: membrane associated guanylate kinase, WW and PDZ domain containing 3
  Uniprot ID: Q5TCQ9
  ENST ID: ENST00000369611
  CDS Start-End: 46-3423
cggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtaaatttgcatgtcttgtaaatcactttcttcttttgttttcttttaaattaaaaatgatgctattaaatacatctatttctatcttctgcacttttcagtcttcttttgacattaaatttgacagcttaa

SEQ ID NO: 152681 - DNA, 6508 bp, Homo sapiens
  Payload ID: 10041
  Gene Symbol: MAGI3
  Gene Name: membrane associated guanylate kinase, WW and PDZ domain containing 3
  Uniprot ID: Q5TCQ9
  ENST ID: ENST00000369615
  CDS Start-End: 63-3440
gggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaaaaaaaca

SEQ ID NO: 152682 - DNA, 3911 bp, Homo sapiens
  Payload ID: 10041
  Gene Symbol: MAGI3
  Gene Name: membrane associated guanylate kinase, WW and PDZ domain containing 3
  Uniprot ID: Q5TCQ9
  ENST ID: ENST00000369617
  CDS Start-End: 286-3738
ctcctggggacaattcccttttcctttcttcagcctaacccgcggtggccctcgcggagtccggtcagccccggggagcgcagccgggaggggcgtccaaggggcgtctcgcgtctgggaacggccgggcccccagcgggctgtggtcgcggggtgggggccggagcggcgaggccccccttaccgggctgcgcgggccgcccagggcccccgggctgagacggggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatttcactcttgtcgcccaagctggagtgcaatggcatgatctcggctcactgcaacctccgcctcctgggttcaatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtaaatttgcatgtcttgtaaatcactttcttcttttgttttcttttaaattaaaaatgatgctattaaatacatctatttctatcttctgcacttttcagtcttcttttgacattaaatttgacagcttaa

SEQ ID NO: 152683 - DNA, 1794 bp, Homo sapiens
  Payload ID: 10042
  Gene Symbol: MBOAT1
  Gene Name: membrane bound O-acyltransferase domain containing 1
  Uniprot ID: Q6ZNC8
  ENST ID: ENST00000324607
  CDS Start-End: 166-1653
gagagtttgcgccggttcgcattccccggcctcccgttcgctcccccgcgaaccaggcggccgtgcgcctctcggggcaaccacccaagagcacccgggcgggaggacgccgagcagggggtgttgcgggctgggacaggggcagccacctcccgaagatgcaggatggcagcagagccgcagccgtccagcctttcctaccgcaccacgggctccacctacctgcacccgctcagcgagctcctgggcatcccgctggaccaggtgaattttgtggtatgccagcttgttgctctgtttgctgctttctggtttcgcatctacttacgtcctggtacaaccagctctgatgtccggcatgcggttgccaccatttttggcatctattttgtcatcttttgtttcggctggtactctgtgcatctttttgtgctggtgttaatgtgctatgcaatcatggtcactgctagtgtatccaatattcacagatattccttttttgtagcaatgggatatcttacaatatgccacatcagccgaatatacatcttccactatggaattctcactacggatttttctgggcctctgatgattgtcactcagaagatcacaaccttggcattccaggttcatgatggattaggtcgaagagctgaagacctttctgctgaacaacatcgacttgctatcaaagtgaaaccctcttttttggaatacttaagttaccttctcaatttcatgagtgtcatagctggtccttgtaacaatttcaaggactacatagccttcattgaggggaagcatatacacatgaagttgctggaggtgaactggaagcgaaaaggtttccacagcttgccagaaccttctcccacaggagctgtgatacacaagttgggcatcaccttggtgtctctccttttgtttttgacgctaacgaagacctttcctgtcacctgccttgtggatgactggtttgtccataaagcaagctttccggctcgactctgctacttatatgttgtcatgcaagcctcaaagcccaagtattactttgcatggacattagctgatgcagtgaataacgcagctggctttgggttcagcggagtggataagaatgggaatttctgttgggatctgctttcgaacctaaacatctggaaaattgagactgccacaagtttcaaaatgtacttggaaaactggaatattcagacagctacttggctaaagtgtgtgtgctatcagcgggttccatggtaccccacggtgctaaccttcatcctgtctgctttgtggcatggtgtctaccctggatactattttaccttcttaactggaattcttgtcacattagcagctagagcggtcaggaacaactacagacattacttcctttcttcaagagctctcaaggctgtgtatgatgcaggcacctgggccgtcactcagctggctgtctcttacacggtagcaccctttgtgatgttggcagttgaaccgaccatcagcttatacaagtccatgtacttttatttgcacatcataagtctcctgataatactatttctgccaatgaaaccacaagctcatacgcaaaggcggcctcagactctgaactctattaataagagaaaaacagattgatacctccaagagaagcggaacaagcaaaactgcagaacgttcgaaagatgagatgacaaggcttcaagggctcctccggtggcttagaggcgatgtttacatgcatctttattttgttcttttttaaagtgcagggagtat

SEQ ID NO: 152684 - DNA, 7751 bp, Homo sapiens
  Payload ID: 10043
  Gene Symbol: MBOAT2
  Gene Name: membrane bound O-acyltransferase domain containing 2
  Uniprot ID: Q6ZWT7
  ENST ID: ENST00000305997
  CDS Start-End: 200-1762
cgggcgcgggaggaggtggcggcggagggggaggtgcgagccgggcaccgcccccggcccctccccggccttccccgcgcagagctccgaccgcgggcggcccaggggcgggcgcgccgctgcatccccatcctcgtcgtcgcccggcacagcgcgagcgggcgagcggcgcgggcggccggagcgccgaggcccggccatggccaccaccagcaccacgggctccaccctgctgcagcccctcagcaacgccgtgcagctgcccatcgaccaggtcaactttgtagtgtgccaactctttgccttgctagcagccatttggtttcgaacttatctacattcaagcaaaactagctcttttataagacatgtagttgctacccttttgggcctttatcttgcacttttttgctttggatggtatgccttacactttcttgtacaaagtggaatttcctactgtatcatgatcatcataggagtggagaacatgcacaattactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtctccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaaagtcactgagtctgggtgacattttttaagaataatataaattcagtttcaaactcttctcacattaaaattttgctgtgaactcttactaaaatgagttttaggttctgtaagtggaaaaatgtgcttttattttatgggccatttttaccacaactaatcttgccttggattactaagcatctcctgcgatcccacagaggactgtggtggccacaggagctgaaagcagaagagtgggatttgatgccaggcagtggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgaggtgggcggatcacttgaggtcaggagttggagaccagcctggccaacgtggtgaatccccgtctctactgaaaacacaaaaattagacgggcatggtggcgcacacctgtaatcccagctacttgggaggctgaggcaggagaattgcttgaacctgggaggtggaggttgcagtgagctaaaattgtgccactgcactccagcctgggtgacagaggaagactccgtctcacaaaaaaaaaaaaagaaaaaagaaattatgccagctgtttaatgtgagagaatagaaagaatgttcatggaatgtacctgccctgtaaaatgtttgatcattttcattaatgttgcagagaatccgactgctattaagagaaagtgaacaaattaagaatttaaaagacaggttcaggcatgtcataagtgaaaacaagaaggcttaatacaaacttgttgggttttgttcgtgtgtgtgtgtgtgtgtgtgtgtgtgtttttttttggttcagcctatctagccacctacaaataatcacatttctgttacctgaatttatttctcagcctgtaaaccttagtcactgttacctgtttcttgctcagtgaatatgatcttggcactgtcatctagaaagcaagatatttgattggttttctggttccttcgaagataataattccatatccagtttgactgattttcatacccctgaatcaactagttattttcatgaaatggtttttggatatctctcctctagtttggagaagtaataatcacaaagattaatattttgcttctagtacttacagtagaagaattttaaactggtacgtctactcctgttaaatagaaaggggattcgttgtattatgtgcttgcttttttttaatcaatagaataagattcaatgcatatttatgttttatattttccactattcaggtatcatgaaatcactctagagatgatcaatcaacatcatatttatacttttggttaattatatactactcagggaaaaaatgaacaaaaataactactcatccttcaatttcattttcttgaaacagtaagagtataatttggtatgcctcagctgtcaccattttataagtggctcattctgttcttaaagtaagtatttttattggaactcagggtaattgggggaatttatttagcttctaaaatatccggcaggatagagaagatttatttggcttcaaaaatgtctggtgaccacttctcttattagccactactgcccatttgcttcaaaaatatatttattggtctccaccatgtgtgacacacacaggatttccaaacataccacttttgagaaaaatgtgcagtaaaaaggaggtttctagaaagtgacagtaactcacatttaagcactagctgacctaggaggagacctggatcttcattctggttctgcctttcatgagacttaagacttggaggagccacctgtcctgtagaccccaagttcctcagccataagcaaacgggttaatcctaagagttcaggaccagttgggtgtcgtgaacggagccattagcaaggtctgtaggattcaaggacttgggcacattcacagtccacactattgtcatggtcattgacttactacttgagctcaaagccctgacatttcaaaaggttgtcatgataacagtgaaacctctgaatcccttaaatcagaaggcatggcaacatactttttctactggcaatagctcttacaatgagtgtttcataatgaaatagtctctgctgaagaaaacatgttttccttttgctctctctgctttgttggtttctgtgctgtgtggaattggagaagatatatgctctgaaatattttatacagattactgactactggacagggtttaccactatataacatctcaaagttattcaaggatatttaaagcatatttagtttagttacaccttattttaaaccgcagaaaacaatagctttaaaatttttgccattaaaataattataaatttatacttttactcaaggactagatcacagttttaggacaaaaatctctcctatttaaagttcataccttgtaagtatttagtttgtatattcatgaacaaatctggacatttatactttttttgtttccttatcaactgttcacaattattagttaattggtcttaacagttctacattataattgaaagaaaaattacttgagaaaataattgtttcagaatagtgcctactatatctgtgtcagctaaaaatttgtccagagttttagatataagctagtattttgtggagttttatccaggcgttaatagttcttcctggctgaaatttaatataggtgcagaatcctaaataacactgtgagatgtaatcttaactgccctcaataccttataaaactgctgcatttaacccagtgtgcatttaatgagtggctggtcgttgatacactcatcttagatgctgaaatttctgttttctccagcccttgtaaaagtgggtttcttgatgaacgcgtgctcccaatgctgaagcaaaagatttgcatttaaggagagaaatacaccctgaaatttgagtttgaaagattagaacatagagggtctctacagtgtttttctgcaacaccaagtagtcaaatctatttatagaaactctgattacaacagaaattttaaaatgaaattttccacatcggtattttgtaggaaagctcttataatcaatgcttaagctgctttttgaggcttttcttgtacagaggttgcagccaattacattttaattggtaggctgctgaataatgtttttgtatgttttaaaataatatttattttaataggttttttaacattatgcaaatcccaataaagaactgacacgttccataggccattgactgggaaattttgtgaaacacagcctaaatacacagtttttacaccaactaatttgtcttgcctttaaaactgattataactcttctttaagtacaacttttataaagaaaaaatacaacactaagactgtatgttctgtaaattatagtgtgatgacccatgcagaaccgctgtctgaagcttactcagcgattcatagccatctccagccatgttttatcaaatcacacactaaaaataaatggaaatgctacagtgaaaaaccaaaagttacagagcaacataagtaaaatgactaggcagtttcttagtaacatgtttgaaatgggaaaggtgactgactgcctttcaccagagtcttagctgtttcacgttcactattttaggttaattttcttgggaaatcaatttgaatattcccccctgtccttttgcattaaaggacgaaaatatatgttgagagtttgacagactttttaaatatgcctctttcccaattttatgtatttttggttctgcgcacacagatttatcaatgaagtacatttgcctctggctttatcacaaggaaaaaggaatcaaacattgaacacaaatgtgttccaaaccagtcttgtccatcttgtcacttttatgtgactgctcctctgaaccagaaggggcacgatagaaggccataggaatgaaagtaaatcattcaggtgaagtgagaaattcttccatatacagagtgaaaatgtgtgatttcattcctgccttcctttaaacgttgtcttgatctctgcctagtagtagttgagccctcagtcgcccaaacatgaggagagacccaactccagcagccagaatttagtatttacatttgccttcccaagttgagaatagaatgtggtgttctgtgctttctgtttttattattccaaaatatttttttaaagaagtgttatttttcaacagattcataaattagttcctgatgtacggtaaattaaaactcccactgtgtcagtcaaactgagatgtgctcatttcataaccactcatttctagtctgtcagagctgcactggtggcttattgctggtttttaaaggtgtttttaacttacatgtaacatgtttaggacatgttttttttttctaatttgtgtgtctttacaactgattaaacagtagtttaaaaata

SEQ ID NO: 152685 - DNA, 580 bp, Homo sapiens
  Payload ID: 10043
  Gene Symbol: MBOAT2
  Gene Name: membrane bound O-acyltransferase domain containing 2
  ENST ID: ENST00000462696
  CDS Start-End: 52-580
acagcgcgagcgggcgagcggcgcgggcggccggagcgccgaggcccggccatggccaccaccagcaccacgggctccaccctgctgcagcccctcagcaacgccgtgcagctgcccatcgaccaggctgcccgccacatgattcccgggtgtctttccccttccgtgtgtctcacgtacctggcagagtccacaggcgaaaagtatgccttacactttcttgtacaaagtggaatttcctactgtatcatgatcatcataggagtggagaacatgcacaattactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacatta

SEQ ID NO: 152686 - DNA, 1227 bp, Homo sapiens
  Payload ID: 10043
  Gene Symbol: MBOAT2
  Gene Name: membrane bound O-acyltransferase domain containing 2
  ENST ID: ENST00000471753
  CDS Start-End: 1-477
aaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagaattttctgaaggagagataaaaactgagttaaataaagatgatcagaatggatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtctccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcg

SEQ ID NO: 152687 - DNA, 754 bp, Homo sapiens
  Payload ID: 10043
  Gene Symbol: MBOAT2
  Gene Name: membrane bound O-acyltransferase domain containing 2
  ENST ID: ENST00000477073
  CDS Start-End: 96-236
ggggcgggcgcgccgctgcatccccatcctcgtcgtcgcccggcacagcgcgagcgggcgagcggcgcgggcggccggagcgccgaggcccggccatggccaccaccagcaccacgggctccaccctgctgcagcccctcagcaacgccgtgcagctgcccatcgaccagttactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctag

SEQ ID NO: 152688 - DNA, 1512 bp, Homo sapiens
  Payload ID: 10044
  Gene Symbol: MBOAT4
  Gene Name: membrane bound O-acyltransferase domain containing 4
  Uniprot ID: Q96T53
  ENST ID: ENST00000320542
  CDS Start-End: 86-1393
agagacagcctggttgagattactcttggaggaaggcatcagttaaggacactggaaaagacaggctcttttgttctggttcctaatggagtggctttggctgttctttctccatcctatatcgttttaccagggggctgcatttccctttgcacttctcttcaattatctctgcatcatggattcattctccactcgtgccaggtacctctttctcctgactggaggaggtgccctggccgtggctgccatgggttcctacgccgtgctcgtcttcacccctgctgtctgcgctgtggctctcctctgttccctggctcctcagcaagtccacaggtggaccttctgctttcagatgagctggcagaccttgtgtcacctaggtctgcactacactgagtattatctgcatgagcctccttctgtgaggttctgcatcactctttcttctctcatgctcttgacccagagggtcacgtccctctctctggacatttgtgaggggaaagtgaaggcagcatctggaggcttcaggagcaggagctctttgtctgagcatgtgtgtaaggcactgccctatttcagctacttgctctttttccctgctctcctgggaggctctctgtgctccttccagcgatttcaggctcgtgttcaagggtccagtgctttgcatcccagacactctttctgggctctgagctggaggggtctgcagattcttggactagaatgcctaaacgtggcagtgagcagggtggtggatgcaggagcgggactgactgattgccagcaattcgagtgcatctatgtcgtgtggaccacagctgggcttttcaagctcacctactactcccactggatcctggacgactccctcctccacgcagcgggctttgggcctgagcttggtcagagccctggagaggagggatatgtccccgatgcagacatctggaccctggaaagaacccacaggatatctgtgttctcaagaaagtggaaccaaagcacagctcgatggctccgacggcttgtattccagcacagcagggcttggccgttgttgcagacatttgccttctctgcctggtggcatggactccatccaggacaggtgtttggtttcgtttgctgggccgtgatggtggaagctgactacctgattcactcctttgccaatgagtttatcagatcctggccgatgaggctgttctatagaaccctcacctgggcccacacccagttgatcattgcctacatcatgctggctgtggaggtcaggagtctctcctctctctggttgctctgtaattcgtacaacagtgtctttcccatggtgtactgtattctgcttttgctattggcgaagagaaagcacaaatgtaactgacatctttccctggctttcaccttaaacacccaggaaacattttagaaagtgccagatgacgcatcgataatgcatacatttgaacttttccataataaaattttttctaaagttttgga

SEQ ID NO: 152689 - DNA, 2529 bp, Homo sapiens
  Payload ID: 10045
  Gene Symbol: MBOAT7
  Gene Name: membrane bound O-acyltransferase domain containing 7
  Uniprot ID: Q96N66
  ENST ID: ENST00000245615
  CDS Start-End: 482-1900
gttctcgactattgccgaagtgagccgaagtttgtggccccgcttccggagaactcaagctcccgattgtgcccgaaggaacccgaagggagaccccgcctcattcctcacgccgagctccagaccccgcctcctttccagagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatcgcttggcctatgacaggtcaccgtgtgtaaatctttcccaataaagtgttgcacaaag

SEQ ID NO: 152690 - DNA, 2076 bp, Homo sapiens
  Payload ID: 10045
  Gene Symbol: MBOAT7
  Gene Name: membrane bound O-acyltransferase domain containing 7
  Uniprot ID: Q96N66
  ENST ID: ENST00000338624
  CDS Start-End: 248-1447
gactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatcgcttggcctatgacaggtcaccgtgtgtaaatctttcccaataaagtgttgcacaaag

SEQ ID NO: 152691 - DNA, 1797 bp, Homo sapiens
  Payload ID: 10045
  Gene Symbol: MBOAT7
  Gene Name: membrane bound O-acyltransferase domain containing 7
  Uniprot ID: Q96N66
  ENST ID: ENST00000391754
  CDS Start-End: 339-1373
cccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggtgagtgagcccgcccagtctcaggtgacactgcagaactacatctcccagcaggccccagggtagcctgcagcgtccctggctgggcccctgcccccggaggctcatgggaattgtagtttgtttagcctggttttgccctgcctctaattatagtggcagcatgccggtgtaaaatcgttccccctctcggggcctcagttgctacttctgtaaagtcagcctcactcagcagaagcaatgtactgagtcctgtggactcaatagccagccttcctggaatcttggccgtccaggttatggagaaaccttgaggagttagttgacctcttagttgcctcaagtgttgaatggagtgaatgctatttattactggtttcataggtagatagaaggactaaatgtgataaaatgtgaaatgtatttaa

SEQ ID NO: 152692 - DNA, 876 bp, Homo sapiens
  Payload ID: 10045
  Gene Symbol: MBOAT7
  Gene Name: membrane bound O-acyltransferase domain containing 7
  ENST ID: ENST00000414665
  CDS Start-End: 109-876
cggcggcagggtctctgcgggctggcgggtgcggggcggccccggaggcgcgttggaactcggggctggcgcaaccgcctgtggctctgccggggatgcgctgggaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgc

SEQ ID NO: 152693 - DNA, 2033 bp, Homo sapiens
  Payload ID: 10045
  Gene Symbol: MBOAT7
  Gene Name: membrane bound O-acyltransferase domain containing 7
  ENST ID: ENST00000437868
  CDS Start-End: 110-322
ggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatcgcttggcctatgacaggtcaccgtgtgtaaatctttcccaataaagtgttgcacaaaggca

SEQ ID NO: 152694 - DNA, 707 bp, Homo sapiens
  Payload ID: 10045
  Gene Symbol: MBOAT7
  Gene Name: membrane bound O-acyltransferase domain containing 7
  ENST ID: ENST00000449249
  CDS Start-End: 1-372
cacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagc

SEQ ID NO: 152695 - DNA, 557 bp, Homo sapiens
  Payload ID: 10045
  Gene Symbol: MBOAT7
  Gene Name: membrane bound O-acyltransferase domain containing 7
  ENST ID: ENST00000453320
  CDS Start-End: 47-557
agctcaggtgggccagggtggcggcgcccagtggcgaggcgagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctacc

SEQ ID NO: 152696 - DNA, 2471 bp, Homo sapiens
  Payload ID: 10045
  Gene Symbol: MBOAT7
  Gene Name: membrane bound O-acyltransferase domain containing 7
  Uniprot ID: Q96N66
  ENST ID: ENST00000431666
  CDS Start-End: 641-1840
taaggactcgactacctccgaagaaagccgaaacatgtggctccgcccacagtggcctcagctctccgttctcgactattgccgaagtgagccgaagtttgtggccccgcttccggagaactcaagctcccgattgtgcccgaaggaacccgaagggagaccccgcctcattcctcacgccgagctccagaccccgcctcctttccagagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatcgcttggcctatgacaggtcaccgtgtgtaaatctttcccaataaagtgttgcacaaaggc

SEQ ID NO: 152697 - DNA, 1585 bp, Homo sapiens
  Payload ID: 10045
  Gene Symbol: MBOAT7
  Gene Name: membrane bound O-acyltransferase domain containing 7
  ENST ID: ENST00000495279
  CDS Start-End: 1-545
ggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaag

SEQ ID NO: 152698 - DNA, 911 bp, Homo sapiens
  Payload ID: 10045
  Gene Symbol: MBOAT7
  Gene Name: membrane bound O-acyltransferase domain containing 7
  ENST ID: ENST00000620231
  CDS Start-End: 144-911
agggtggcggcgcccagtggcgaggcgaggttacacggcggcagggtctctgcgggctggcgggtgcggggcggccccggaggcgcgttggaactcggggctggcgcaaccgcctgtggctctgccggggatgcgctgggaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgc

SEQ ID NO: 152699 - DNA, 2471 bp, Homo sapiens
  Payload ID: 10045
  Gene Symbol: MBOAT7
  Gene Name: membrane bound O-acyltransferase domain containing 7
  ENST ID: ENST00000621455
  CDS Start-End: 641-1840
taaggactcgactacctccgaagaaagccgaaacatgtggctccgcccacactggcctcagctctccgttctcgactattgccgaagtgagccgaagtttgtggccccgcttccggagaactcaagctcccgattgtgcccgaaggaacccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaaggc

SEQ ID NO: 152700 - DNA, 2598 bp, Homo sapiens
  Payload ID: 10045
  Gene Symbol: MBOAT7
  Gene Name: membrane bound O-acyltransferase domain containing 7
  ENST ID: ENST00000621875
  CDS Start-End: 549-1967
taaggactcgactacctccgaagaaagccgaaacatgtggctccgcccacactggcctcagctctccgttctcgactattgccgaagtgagccgaagtttgtggccccgcttccggagaactcaagctcccgattgtgcccgaaggaacccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaaggc

SEQ ID NO: 152701 - DNA, 2598 bp, Homo sapiens; identical to SEQ ID NO: 152700
  Payload ID: 10045
  Gene Symbol: MBOAT7
  Gene Name: membrane bound O-acyltransferase domain containing 7
  ENST ID: ENST00000621612
  CDS Start-End: 549-1967

SEQ ID NO: 152702 - DNA, 2392 bp, Homo sapiens
  Payload ID: 10045
  Gene Symbol: MBOAT7
  Gene Name: membrane bound O-acyltransferase domain containing 7
  Uniprot ID: Q96N66
  ENST ID: ENST00000620311
  CDS Start-End: 562-1761
taaggactcgactacctccgaagaaagccgaaacatgtggctccgcccacactggcctcagctctccgttctcgactattgccgaagtgagccgaagtttgtggccccgcttccggagaactcaagctcccgattgtgcccgaaggaacccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaaggc

SEQ ID NO: 152703 - DNA, 911 bp, Homo sapiens; identical to SEQ ID NO: 152698
  Payload ID: 10045
  Gene Symbol: MBOAT7
  Gene Name: membrane bound O-acyltransferase domain containing 7
  ENST ID: ENST00000617324
  CDS Start-End: 144-911

SEQ ID NO: 152704 - DNA, 2598 bp, Homo sapiens; identical to SEQ ID NO: 152700
  Payload ID: 10045
  Gene Symbol: MBOAT7
  Gene Name: membrane bound O-acyltransferase domain containing 7
  ENST ID: ENST00000613506
  CDS Start-End: 549-1967

SEQ ID NO: 152705 - DNA, 557 bp, Homo sapiens; identical to SEQ ID NO: 152695
  Payload ID: 10045
  Gene Symbol: MBOAT7
  Gene Name: membrane bound O-acyltransferase domain containing 7
  ENST ID: ENST00000612519
  CDS Start-End: 47-557

SEQ ID NO: 152706 - DNA, 1797 bp, Homo sapiens; identical to SEQ ID NO: 152691
  Payload ID: 10045
  Gene Symbol: MBOAT7
  Gene Name: membrane bound O-acyltransferase domain containing 7
  Uniprot ID: Q96N66
  ENST ID: ENST00000619670
  CDS Start-End: 339-1373

SEQ ID NO: 152707 - DNA, 2392 bp, Homo sapiens
  Payload ID: 10045
  Gene Symbol: MBOAT7
  Gene Name: membrane bound O-acyltransferase domain containing 7
  ENST ID: ENST00000620371
  CDS Start-End: 562-1761
taaggactcgactacctccgaagaaagccgaaacatgtggctccgcccacagtggcctcagctctccgttctcgactattgccgaagtgagccgaagtttgtggccccgcttccggagaactcaagctcccgattgtgcccgaaggaacccgaagggagaccccgcctcattcctcacgccgagctccagaccccgcctcctttccagagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggctgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatagcttggcctatgacaggtcaccgtgtgtaaatctttcccaataaagtgttgcacaaaggc

SEQ ID NO: 152708 - DNA, 876 bp, Homo sapiens; identical to SEQ ID NO: 152692
  Payload ID: 10045
  Gene Symbol: MBOAT7
  Gene Name: membrane bound O-acyltransferase domain containing 7
  ENST ID: ENST00000619844
  CDS Start-End: 109-876

SEQ ID NO: 152709 - DNA, 1797 bp, Homo sapiens; identical to SEQ ID NO: 152691
  Payload ID: 10045
  Gene Symbol: MBOAT7
  Gene Name: membrane bound O-acyltransferase domain containing 7
  ENST ID: ENST00000618899
  CDS Start-End: 339-1373

SEQ ID NO: 152710 - DNA, 2392 bp, Homo sapiens; identical to SEQ ID NO: 152702
  Payload ID: 10045
  Gene Symbol: MBOAT7
  Gene Name: membrane bound O-acyltransferase domain containing 7
  ENST ID: ENST00000617772
  CDS Start-End: 562-1761

SEQ ID NO: 152711 - DNA, 2392 bp, Homo sapiens; identical to SEQ ID NO: 152707
  Payload ID: 10045
  Gene Symbol: MBOAT7
  Gene Name: membrane bound O-acyltransferase domain containing 7
  ENST ID: ENST00000614279
  CDS Start-End: 562-1761

SEQ ID NO: 152712 - DNA, 1811 bp, Homo sapiens
  Payload ID: 10045
  Gene Symbol: MBOAT7
  Gene Name: membrane bound O-acyltransferase domain containing 7
  ENST ID: ENST00000610862
  CDS Start-End: 339-1373
cccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggtgagtgagcccgcccagtctcaggtgacactgcagaactacatctcccagcaggccccagggtagcctgcagcgtccctggctgggcccctgcccccggaggctcatgggaattgtagtttgtttagcctggttttgccctgcctctaattatagtggcagcatgccggtgtaaaatcgttccccctctcggggcctcagttgctacttctgtaaagtcagcctcactcagcagaagcaatgtactgagtcctgtggactcaatagccagccttcctggaatcttggccgtccaggttatggagaaaccttgaggagttagttgacctcttagttgcctcaagtgttgaatggagtgaatgctatttattactggtttcataggtagatagaaggactaaatgtgataaaatgtgaaatgtatttaatgtgaggcctgaca

SEQ ID NO: 152713 - DNA, 2033 bp, Homo sapiens
  Payload ID: 10045
  Gene Symbol: MBOAT7
  Gene Name: membrane bound O-acyltransferase domain containing 7
  ENST ID: ENST00000615872
  CDS Start-End: 110-322
ggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaaggca

SEQ ID NO: 152714 - DNA, 2598 bp, Homo sapiens; identical to SEQ ID NO: 152700
  Payload ID: 10045
  Gene Symbol: MBOAT7
  Gene Name: membrane bound O-acyltransferase domain containing 7
  Uniprot ID: Q96N66
  ENST ID: ENST00000619842
  CDS Start-End: 549-1967

SEQ ID NO: 152715 - DNA, 2471 bp, Homo sapiens; identical to SEQ ID NO: 152699
  Payload ID: 10045
  Gene Symbol: MBOAT7
  Gene Name: membrane bound O-acyltransferase domain containing 7
  ENST ID: ENST00000619745
  CDS Start-End: 641-1840

SEQ ID NO: 152716 - DNA, 2471 bp, Homo sapiens; identical to SEQ ID NO: 152699
  Payload ID: 10045
  Gene Symbol: MBOAT7
  Gene Name: membrane bound O-acyltransferase domain containing 7
  ENST ID: ENST00000621146
  CDS Start-End: 641-1840

SEQ ID NO: 152717 - DNA, 2471 bp, Homo sapiens; identical to SEQ ID NO: 152699
  Payload ID: 10045
  Gene Symbol: MBOAT7
  Gene Name: membrane bound O-acyltransferase domain containing 7
  ENST ID: ENST00000617656
  CDS Start-End: 641-1840

SEQ ID NO: 152718 - DNA, 2392 bp, Homo sapiens; identical to SEQ ID NO: 152702
  Payload ID: 10045
  Gene Symbol: MBOAT7
  Gene Name: membrane bound O-acyltransferase domain containing 7
  ENST ID: ENST00000611239
  CDS Start-End: 562-1761

SEQ ID NO: 152719 - DNA, 2598 bp, Homo sapiens; identical to SEQ ID NO: 152700
  Payload ID: 10045
  Gene Symbol: MBOAT7
  Gene Name: membrane bound O-acyltransferase domain containing 7
  ENST ID: ENST00000618378
  CDS Start-End: 549-1967

SEQ ID NO: 152720 - DNA, 564 bp, Homo sapiens
  Payload ID: 10045
  Gene Symbol: MBOAT7
  Gene Name: membrane bound O-acyltransferase domain containing 7
  ENST ID: ENST00000617095
  CDS Start-End: 47-564
agctcaggtgggccagggtggcggcgcccagtggcgaggcgagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcaccta

SEQ ID NO: 152721 - DNA, 1585 bp, Homo sapiens; identical to SEQ ID NO: 152697
  Payload ID: 10045
  Gene Symbol: MBOAT7
  Gene Name: membrane bound O-acyltransferase domain containing 7
  ENST ID: ENST00000612092
  CDS Start-End: 1-545

SEQ ID NO: 152722 - DNA, 2471 bp, Homo sapiens; identical to SEQ ID NO: 152699
  Payload ID: 10045
  Gene Symbol: MBOAT7
  Gene Name: membrane bound O-acyltransferase domain containing 7
  ENST ID: ENST00000611602
  CDS Start-End: 641-1840

SEQ ID NO: 152723 - DNA, 2598 bp, Homo sapiens; identical to SEQ ID NO: 152700
  Payload ID: 10045
  Gene Symbol: MBOAT7
  Gene Name: membrane bound O-acyltransferase domain containing 7
  ENST ID: ENST00000615453
  CDS Start-End: 549-1967

SEQ ID NO: 152724 - DNA, 2392 bp, Homo sapiens; identical to SEQ ID NO: 152702
  Payload ID: 10045
  Gene Symbol: MBOAT7
  Gene Name: membrane bound O-acyltransferase domain containing 7
  ENST ID: ENST00000620636
  CDS Start-End: 562-1761

SEQ ID NO: 152725 - DNA, 2392 bp, Homo sapiens; identical to SEQ ID NO: 152702
  Payload ID: 10045
  Gene Symbol: MBOAT7
  Gene Name: membrane bound O-acyltransferase domain containing 7
  ENST ID: ENST00000612053
  CDS Start-End: 562-1761

SEQ ID NO: 152726 - DNA, 2392 bp, Homo sapiens; identical to SEQ ID NO: 152702
  Payload ID: 10045
  Gene Symbol: MBOAT7
  Gene Name: membrane bound O-acyltransferase domain containing 7
  ENST ID: ENST00000612567
  CDS Start-End: 562-1761

SEQ ID NO: 152727 - DNA, 707 bp, Homo sapiens; identical to SEQ ID NO: 152694
  Payload ID: 10045
  Gene Symbol: MBOAT7
  Gene Name: membrane bound O-acyltransferase domain containing 7
  ENST ID: ENST00000621334
  CDS Start-End: 1-372

SEQ ID NO: 152728 - DNA, 2471 bp, Homo sapiens; identical to SEQ ID NO: 152699
  Payload ID: 10045
  Gene Symbol: MBOAT7
  Gene Name: membrane bound O-acyltransferase domain containing 7
  Uniprot ID: Q96N66
  ENST ID: ENST00000618826
  CDS Start-End: 641-1840

SEQ ID NO: 152729 - DNA, 2076 bp, Homo sapiens
  Payload ID: 10045
  Gene Symbol: MBOAT7
  Gene Name: membrane bound O-acyltransferase domain containing 7
  Uniprot ID: Q96N66
  ENST ID: ENST00000615282
  CDS Start-End: 248-1447
gactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 152730 - DNA, 564 bp, Homo sapiens; identical to SEQ ID NO: 152720
  Payload ID: 10045
  Gene Symbol: MBOAT7
  Gene Name: membrane bound O-acyltransferase domain containing 7
  ENST ID: ENST00000616849
  CDS Start-End: 47-564

SEQ ID NO: 152731 - DNA, 2596 bp, Homo sapiens
  Payload ID: 10045
  Gene Symbol: MBOAT7
  Gene Name: membrane bound O-acyltransferase domain containing 7
  ENST ID: ENST00000617012
  CDS Start-End: 549-1967
taaggactcgactacctccgaagaaagccgaaacatgtggctccgcccacagtggcctcagctctccgttctcgactattgccgaagtgagccgaagtttgtggccccgcttccggagaactcaagctcccgattgtgcccgaaggaacccgaagggagaccccgcctcattcctcacgccgagctccagaccccgcctcctttccagagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggctgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatagcttggcctatgacaggtcaccgtgtgtaaatctttcccaataaagtgttgcacaaag

SEQ ID NO: 152732 - DNA, 2529 bp, Homo sapiens
  Payload ID: 10045
  Gene Symbol: MBOAT7
  Gene Name: membrane bound O-acyltransferase domain containing 7
  Uniprot ID: Q96N66
  ENST ID: ENST00000613746
  CDS Start-End: 482-1900
gttctcgactattgccgaagtgagccgaagtttgtggccccgcttccggagaactcaagctcccgattgtgcccgaaggaacccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 152733 - DNA, 2596 bp, Homo sapiens; identical to SEQ ID NO: 152731
  Payload ID: 10045
  Gene Symbol: MBOAT7
  Gene Name: membrane bound O-acyltransferase domain containing 7
  ENST ID: ENST00000619855
  CDS Start-End: 549-1967

SEQ ID NO: 152734 - DNA, 1663 bp, Homo sapiens
  Payload ID: 10046
  Gene Symbol: MFRP
  Gene Name: membrane frizzled-related protein
  Uniprot ID: Q9BY79
  ENST ID: ENST00000360167
  CDS Start-End: 153-1538
aaggacagcccaagaactggtctagcctggcagccttttccctcgggtagtagaggctgcccctctgacagggagtttgtggtcagcgagtgggcccttgggggtcttgggctgtcacagggactccagaaagccatgcagagccttgtgccatgaaggacttctcagatgtcatcctctgcatggaggcaacagaatcgagcaagaccgagttctgcaatcctgccttcgagcctgagtctgggccaccctgccctcccccagttttcccagaggatgccagctacagcgtcccagctccctggcatggtcggcgtcctcgagggctacggccagactgccgcttctcctggctctgtgtcctcctgctctccagcctgctcctcctgctgcttgggctgctggtggccatcatcctggcccagctgcaggctgcacccccatctggggcgtcccatagcccactgcctgccggaggccttaccacgaccaccaccacccccaccatcaccacctctcaggcagctgggacccctaaagggcagcaggagtcaggcgtgagcccctccccacagtccacctgtggaggcctcctctctggcccaaggggcttcttcagcagccctaactacccagacccttacccccccaacacccactgcgtgtggcatatccaggtggccacagaccatgcaatacagctcaagatcgaagccctcagcatagagagtgtggcctcttgcctttttgatcgcttggaactctcccctgagcctgaaggccccctcctcagggtttgtggaagggtgcctccccccacgctcaacaccaatgccagccacctcctggtggtcttcgtctctgacagcagtgtggaaggatttggtttccatgcctggtaccaggctatggcccctgggcgcgggagctgtgcccatgatgagttccgctgtgaccagctcatctgcctgctacctgactcagtgtgtgatggttttgccaactgtgctgacggcagtgatgagaccaattgcagtgccaagttctcgggttctgtggagcagagccacccccccacctcgtctcctcgcaccatgagctggctgtgctgtttaggacagatcatggcatcagcagtggaggcttctcagccacctacctggccttcaatgccacggagaacccctgtgggcccagtgagctctcctgccaggcaggagggtgtaagggtgtgcagtggatgtgtgacatgtggagagactgcaccgatggcagcgatgacaactgcagcggccccttgttcccacccccagagcctgacaagcctgccctgctaccagcatttccggaggctcctgtgtgggctgcttgtgccccgttgcaccccactaggcagtgttctgcccccttgccgctctgtctgccaggaagcggagcaccagtgccagtctggcctggcactactgggcaccccctggcccttcaactgcaacaggctgccagaggcagctgacctggaagcttgtgcccagccctgaccctgaagccggcccctgccctcttcctgcccgtcctcttttgccggtcagggctggcacgcaggggaacaaaggaaggagcatcagcagggtctctacccatccttctctggggctcccaggga

SEQ ID NO: 152735 - DNA, 565 bp, Homo sapiens
  Payload ID: 10046
  Gene Symbol: MFRP
  Gene Name: membrane frizzled-related protein
  Uniprot ID: Q9BY79
  ENST ID: ENST00000449574
  CDS Start-End: 1-565
cccacctcgtctcctcgcaccatgagctggctgtgctgtttaggacagatcatggcatcagcagtggaggcttctcagccacctacctggccttcaatgccacggagagtaggtgcccctgggcaaacccctgtgggcccagtgagctctcctgccaggcaggagggtgtaagggtgtgcagtggatgtgtgacatgtggagagactgcaccgatggcagcgatgacaactgcagcggccccttgttcccacccccagagctggcctgtgagcctgtccaggtggagatgtgcctcggtctgagctacaacaccacagccttccctaacatctgggtgggcatgatcacccaggaggaggtggtagaggtcctcagcggttacaagagcctgacaagcctgccctgctaccagcatttccggaggctcctgtgtgggctgcttgtgccccgttgcaccccactaggcagtgttctgcccccttgccgctctgtctgccaggaagcggagcaccagtgccagtctggcctggcactactgggcaccccctggcccttcaactgcaa

SEQ ID NO: 152736 - DNA, 3917 bp, Homo sapiens
  Payload ID: 10046
  Gene Symbol: MFRP
  Gene Name: membrane frizzled-related protein
  Uniprot ID: Q9BY79
  ENST ID: ENST00000619721
  CDS Start-End: 161-1900
actctaccaaggacagcccaagaactggtctagcctggcagccttttccctcgggtagtagaggctgcccctctgacagggagtttgtggtcagcgagtgggcccttgggggtcttgggctgtcacagggactccagaaagccatgcagagccttgtgccatgaaggacttctcagatgtcatcctctgcatggaggcaacagaatcgagcaagaccgagttctgcaatcctgccttcgagcctgagtctgggccaccctgccctcccccagttttcccagaggatgccagctacagcgtcccagctccctggcatggtcggcgtcctcgagggctacggccagactgccgcttctcctggctctgtgtcctcctgctctccagcctgctcctcctgctgcttgggctgctggtggccatcatcctggcccagctgcaggctgcacccccatctggggcgtcccatagcccactgcctgccggaggccttaccacgaccaccaccacccccaccatcaccacctctcaggcagctgggacccctaaagggcagcaggagtcaggcgtgagcccctccccacagtccacctgtggaggcctcctctctggcccaaggggcttcttcagcagccctaactacccagacccttacccccccaacacccactgcgtgtggcatatccaggtggccacagaccatgcaatacagctcaagatcgaagccctcagcatagagagtgtggcctcttgcctttttgatcgcttggaactctcccctgagcctgaaggccccctcctcagggtttgtggaagggtgcctccccccacgctcaacaccaatgccagccacctcctggtggtcttcgtctctgacagcagtgtggaaggatttggtttccatgcctggtaccaggctatggcccctgggcgcgggagctgtgcccatgatgagttccgctgtgaccagctcatctgcctgctacctgactcagtgtgtgatggttttgccaactgtgctgacggcagtgatgagaccaattgcagtgccaagttctcggggtgtggggggaatctgactggcctccagggcactttctctactcccagctacctgcagcagtaccctcaccaactgctctgcacctggcatatctcggtgcctgccggacacagcatagaactacagttccacaacttcagcctggaggctcaggacgagtgcaagtttgactacgtggaggtgtatgagaccagcagctcaggggccttcagcctcctgggcaggttctgtggagcagagccacccccccacctcgtctcctcgcaccatgagctggctgtgctgtttaggacagatcatggcatcagcagtggaggcttctcagccacctacctggccttcaatgccacggagaacccctgtgggcccagtgagctctcctgccaggcaggagggtgtaagggtgtgcagtggatgtgtgacatgtggagagactgcaccgatggcagcgatgacaactgcagcggccccttgttcccacccccagagctggcctgtgagcctgtccaggtggagatgtgcctcggtctgagctacaacaccacagccttccctaacatctgggtgggcatgatcacccaggaggaggtggtagaggtcctcagcggttacaagagcctgacaagcctgccctgctaccagcatttccggaggctcctgtgtgggctgcttgtgccccgttgcaccccactaggcagtgttctgcccccttgccgctctgtctgccaggaagcggagcaccagtgccagtctggcctggcactactgggcaccccctggcccttcaactgcaacaggctgccagaggcagctgacctggaagcttgtgcccagccctgaccctgaagccggcccctgccctcttcctgcccgtcctcttttgccggtcagggctggcacgcaggggaacaaaggaaggagcatcagcagggtctctacccatccttctctggggctcccagggagggggaagagaagtcctcagctggggctcatgggaccctaccaccctccctgctccttcctgtccctttaccggtcccaggctgctgactggccccacactgtgccaccggacaatcgagaccacttcccatccaggcctcttcccctttccatctgctttttcagcttctccatcgcctgccttctgaccttttccttgattcaacaaaaatgtactgagcatctattcatgtggcaggcccctgtcctaggccctagggatccaactggctgtctgcctctagaactctccaccctcatctctctgcgtatttctccctgaaatggggtctggtccttggtctctgccactgccctgcctctcctctggccctgggaacaggaggtgccctgtgtgtccgtctctcgaagttctgcctctctgtgcccagctcaagtctctctccccctcctttctccccctaaactttggccggccgccgggcgacaccacgagttatttcccagctatttcccggtccgggagctcttggcccctgaacaactggtttcctcttggagtctgggaggaggaaagcggagccggcagggagcgaaccaggactggggtgacggcagggcagggggcgcctggccggggagaagcgcgggggctggagcaccaccaactggagggtccggagtagcgagcgccccgaaggaggccatcggggagccgggaggggggactgcgagaggaccccggcgtccgggctcccggtgccagcgctatgaggccactcctcgtcctgctgctcctgggcctggcggccggctcgcccccactggacgacaacaagatccccagcctctgcccggggcaccccggccttccaggcacgccgggccaccatggcagccagggcttgccgggccgcgatggccgcgacggccgcgacggcgcgcccggggctccgggagagaaaggcgagggcgggaggccgggactgccgggacctcgaggggaccccgggccgcgaggagaggcgggacccgcggggcccaccgggcctgccggggagtgctcggtgcctccgcgatccgccttcagcgccaagcgctccgagagccgggtgcctccgccgtctgacgcacccttgcccttcgaccgcgtgctggtgaacgagcagggacattacgacgccgtcaccggcaagttcacctgccaggtgcctggggtctactacttcgccgtccatgccaccgtctaccgggccagcctgcagtttgatctggtgaagaatggcgaatccattgcctctttcttccagtttttcggggggtggcccaagccagcctcgctctcggggggggccatggtgaggctggagcctgaggaccaagtgtgggtgcaggtgggtgtgggtgactacattggcatctatgccagcatcaagacagacagcaccttctccggatttctggtgtactccgactggcacagctccccagtctttgcttagtgcccactgcaaagtgagctcatgctctcactcctagaaggagggtgtgaggctgacaaccaggtcatccaggagggctggcccccctggaatattgtgaatgactagggaggtggggtagagcactctccgtcctgctgctggcaaggaatgggaacagtggctgtctgcgatcaggtctggcagcatggggcagtggctggatttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcactcaataaacctaagaaccctc

SEQ ID NO: 152737 - DNA, 723 bp, Homo sapiens
  Payload ID: 10046
  Gene Symbol: MFRP
  Gene Name: membrane frizzled-related protein
  ENST ID: ENST00000634542
  CDS Start-End: 105-410
agtagaggctgcccctctgacagggagtttgtggtcagcgagtgggcccttgggggtcttgggctgtcacagggactccagaaagccatgcagagccttgtgccatgaaggacttctcagatgtcatcctctgcatggaggcaacagaatcgagcaaggtcggcgtcctcgagggctacggccagactgccgcttctcctggctctgtgtcctcctgctctccagcctgctcctcctgctgcttgggctgctggtggccatcatcctggcccagctgcaggctgcacccccatctggggcgtcccatagcccactgcctgccggaggccttaccacgaccaccaccacccccaccatcaccacctctcaggcagctgggacccctaaagggcagcaggagtcaggcgtgagcccctccccacagtccacctgtggaggcctcctctctggcccaaggggcttcttcagcagccctaactacccagacccttacccccccaacacccactgcgtgtggcatatccaggtggccacagaccatgcaatacagctcaagatcgaagccctcagcatagagagtgtggcctcttgcctttttgatcgcttggaactctcccctgagcctgaaggccccctcctcagggtttgtggaagggtgcctccccccacgctcaacaccaatgccagccacctcctggtggtcttcgtctctgacagcagtgt

SEQ ID NO: 152738 - DNA, 3738 bp, Homo sapiens
  Payload ID: 10047
  Gene Symbol: MMGT1
  Gene Name: membrane magnesium transporter 1
  Uniprot ID: Q8N4V1
  ENST ID: ENST00000305963
  CDS Start-End: 389-784
ctctacgcaggcccccgtccctctgccccaccctgttctcgccactggccctgcccccatttgccggcgcccttcctcttcgcttccccgtagctcccgctttcgcctcttcgtttatgactccgttgggctccggccctcctagagaggcctccatagcgcaggttcgtgggttctcgcggacctttttccgtgtagctttctgcttcttcccggcattcctgtttccgttttctcacagccctctggcttttccaccactgagacactttgcgctcaggacttcagtgacgtcatctttctgcggcgcgcggacacccgccggtggaagaagaaacagctccgccgtccttcgcttcttttgctgggctgctgctccttcggcatcatggcgccgtcgctgtggaaggggctggtgggcatcggtctctttgccctagcccacgccgccttttccgctgcgcagcatcgttcttatatgcgattaacagaaaaagaagatgaatcactgccaatagatatagttcttcagacacttctggcctttgcagttacctgttacggtatagttcatattgcaggagagtttaaagacatggatgccacttcagaactgaaaaataagacatttgatacgttaaggaatcacccatccttttatgtatttaatcatcgtggtcgagtacttttccggccttcggatacagcaaattcttcaaaccaagatgcattgtcctctaacacatcattgaagttacgaaaactcgaatcactgcgtcgttaagatttttacaaattataataataggacaggacacagagctggaatattggagtttggggtataaaacactcctccctgcccccattagtatttatattgatctttcagacctactttagtaaaaaaaaccatggcccttgtttatatactgttaatccaatcattaatgcagtgtaagttatatgtgaaatgagtctttggtatttcatataggaattattttttttttcatttaaaacaaatccacatcttttgtaaaagccactgttttgaacacatttccttgaaaaatgttggtggtttttgtgattatttatttttttagatttcttttcttttgcactacaatttttggaatccttttggaaatactgtgtgactgctgtgttttgcagcatgaattatagtaaaatggtcttcaattcttaacaaatggacttccctgatgagaccaaaatggtgatttaacagtttttcttgtgtcccctaaaaagtggctctgcttcagaagtacttgccagtttttaatttatttgtgacttttcaccctaccctgctcccatataccttctaccatcagctgtcttgtttcatcatttctctgagattctgtgtgcagtgagcaatttttgtgtcagaaattctttgtcagaacaaatatatgtaacaggctcaacttactgtaaagctacttgtgttctcttcatttgtctgtaaaaatttccctaattgattatatagtgtaagaatagttgaagactagttgaagaccttttgtgatttcattatcatgcctatgcagaagaaaaatcattgaggaaaattgtcattagccagtttaactgattcaaactctgtttatttcatactaaactagtgaataagtgaaataaaggaaactcgtcattaatctaaagacagagttcaaaggaattgggccaaatatattctcagtatttggaactaatgtttttaaggtttttaggaaaatcaggtcatttaagaaattgttttgtagtttctggtttatagcagtcttcaagttttccatcttcactgtatgttgctgaaagtgaggatgaggatacagagttgatatttttagaaacagtaattttacttttaaggaaattggctagctctttgagctagagagctgtaggaagctcaacatttctttgtagagaacgttgctttttttggattgtacaggtataaaaacattgcttttgttgaattgtataggtgtaaaaagggaataactgtatgcaggtttgaaaaggaaatgtgctttaggcatgagtcataagatgccattgtacttgtaggcattttattttcctttagaaatggacatcagctcttctcttctgactggtaacacatagccccaaagcatgagattatttttcattgggtttttattgttgtttagttttggtttgttacgccagcccagtctgtctgcggaacactgactctgctctctaatgagaacaaagttagaaatctgccgataacctaaaataatttagaaatgaattaaaaatgtgaaatcgggttaaagtgatgatgataaaatagcatgcaagaaacaagctccttccatcagacttggctactgttttcttctggtacgatttggtttggaagagcctcttgtttccttctctttggggtatgtcttcgtttcttaatatgtttgtaacattattgagatataattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccagtgcccaccccatccccgagcccctggcaaccactaatctatttctctctctgtagatttgcttattctggtcatttcatataaatggaattctacaatattcggtcttttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatatattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagctccccaaatttcttttttcatttactccagtgagtttctgctgtctttttcaagtatgtaccataggacttaaaggtgatttggatgcgttgtaacactgctaaatatgctaagtacagaattttatctacagtactgtgagacagtcaattattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgattattctctgtaactccctaatgattgttttctaagcattgtggcttctcagtggcttgacagcatcttcctggttgtatgtggcctgtttacatgatgtattgaataatgttgtttgttgtgagcatcaatgcctgtaacaccaaactaaacacgtgtttttgggatatgtttccaatctttaaatgaccttgccctgtccaataaataaatgattgtctcaccctgtt

SEQ ID NO: 152739 - DNA, 2360 bp, Homo sapiens
  Payload ID: 10048
  Gene Symbol: MME
  Gene Name: membrane metallo-endopeptidase
  Uniprot ID: P08473
  ENST ID: ENST00000360490
  CDS Start-End: 79-2331
tgggggctgggaatttgccattctgctgtacagacactgatttttttttcttctttttaaaaagcaagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggc

SEQ ID NO: 152740 - DNA, 1319 bp, Homo sapiens
  Payload ID: 10048
  Gene Symbol: MME
  Gene Name: membrane metallo-endopeptidase
  ENST ID: ENST00000382989
  CDS Start-End: 457-699
gctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcaggcatggtagcacgcgcctataatcccagagggaggagaattgcttgaacccaggaggcagaggttgaagcgagccaagattgcacgactgcactccagcctggaagacagcgcaagactctatctccaaaaaaaagaaaaagacaacagagaattgaggggtctgcagaagcatatgttagaagtgtggtcctaaattatccagaggccagagaagccaagctaagacgtgatcaatacagtttacaagagaaagtgggaccacctccacctgtatagtcatgcaggttgtacactgcatatttgtcgatggcagccttgacagacaggcttgtggaacatcaagacctggatgaaacacctctcagaactgtccactccttttattttaattctgcacataccaagaaaacttttgatgattacttaattattaatacaaggagaggtggcattctgttacttgaaagatattttcatcatggtgagataatgcacagcggtccccttcttatcctctgaggatcccccaagacctcagtggatgtctgacactggactgaaccctatatatgctatattttttctgtatacatacctatgataaagtttaatttataaattagacaaagattaataacaataattaataaaaaataaaacgatta

SEQ ID NO: 152741 - DNA, 2556 bp, Homo sapiens
  Payload ID: 10048
  Gene Symbol: MME
  Gene Name: membrane metallo-endopeptidase
  Uniprot ID: P08473
  ENST ID: ENST00000493237
  CDS Start-End: 135-2387
gcggctgccgggaggtgcgctgagcagggtccgcagctaaggtccagcgcgatccgagcgcccaggaccctgcggccgtggaggaggcgtgccctgggaaggagccgctactgggacctgaagaattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaaggg

SEQ ID NO: 152742 - DNA, 593 bp, Homo sapiens
  Payload ID: 10048
  Gene Symbol: MME
  Gene Name: membrane metallo-endopeptidase
  ENST ID: ENST00000462837
  CDS Start-End: 110-593
aacaaaaaacaaaaggttgtgactgagacctgtcaaattcatttggctctatatactttgcattcagcaacaaaattttgacttctcaacagcaaaaatattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttac

SEQ ID NO: 152743 - DNA, 324 bp, Homo sapiens
  Payload ID: 10048
  Gene Symbol: MME
  Gene Name: membrane metallo-endopeptidase
  ENST ID: ENST00000497890
  CDS Start-End: 279-324
gaccattttcagaatgttgtctaaccagttaatagatactggtatcagtagtagtagtaattttgaactgtaaaaataaaggttgtttttatgactaaaataaactacttcatgtgttcattcgttttgctgtttatctatattaatatttcaaattattgcttagtcaaaacctcaaggtattagtcactggtttttgagcttataaaggaagccactggagcaagatataaaattaaccattgatgttagtccagagttcaaaaggattttaggtgatgggcaagtcagaaagtcagatggatataactgatatcaacactc

SEQ ID NO: 152744 - DNA, 5622 bp, Homo sapiens
  Payload ID: 10048
  Gene Symbol: MME
  Gene Name: membrane metallo-endopeptidase
  Uniprot ID: P08473
  ENST ID: ENST00000460393
  CDS Start-End: 121-2373
gagagcgccgagacgcgcggggcgcggagatgtgcaagtggcgaagcttgaccgagagcaggctggagcagccgcccaactcctggcgcgggatctgctgaggggtcacgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgc

SEQ ID NO: 152745 - DNA, 667 bp, Homo sapiens
  Payload ID: 10048
  Gene Symbol: MME
  Gene Name: membrane metallo-endopeptidase
  ENST ID: ENST00000491026
  CDS Start-End: 310-667
gtagagcagcactaaccaggggagtaatatggttggcacttcgtgtccagaactccgtatttcaggctgggaaacacctaattaatgtctgggaaacaagaagatgatttatcctgagtacctctgtcctcagcttctgcagacacagtttaaatatggaaactgtttctccttcttcctgtgcctcagtttccatagaacaaactgtaattgcatagcacagcttcaggaacctgcagatataagttaatgttataatgtgcagtgaagatgaaaactgcttagctaagtctaagtctattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaag

SEQ ID NO: 152746 - DNA, 3590 bp, Homo sapiens
  Payload ID: 10048
  Gene Symbol: MME
  Gene Name: membrane metallo-endopeptidase
  Uniprot ID: P08473
  ENST ID: ENST00000462745
  CDS Start-End: 213-2465
agagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaa

SEQ ID NO: 152747 - DNA, 856 bp, Homo sapiens
  Payload ID: 10048
  Gene Symbol: MME
  Gene Name: membrane metallo-endopeptidase
  ENST ID: ENST00000481828
  CDS Start-End: 157-856
agcctggagcccgcgcgccttgggcggatgcacggactgagaggcgcttggctgggctctcagcccgccactgccacccggccccgtgcgctcattggtcgggatgtgtcggctcagcagcctccaacttctcccgaatcccactgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaat

SEQ ID NO: 152748 - DNA, 2854 bp, Homo sapiens
  Payload ID: 10048
  Gene Symbol: MME
  Gene Name: membrane metallo-endopeptidase
  Uniprot ID: P08473
  ENST ID: ENST00000492661
  CDS Start-End: 212-2464
acattcctactgagtatgacgaatggttgttgatggttatcactggagattgaaaactgggattcctttttcaccaggaattggtgcctaccatggctggggatacacagtgatggatttgtgacttgctcctctgaaagctggcccaagggtgtacagcatatgaatgtgggggagtttacactacacacgctcttggctattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccaga

SEQ ID NO: 152749 - DNA, 892 bp, Homo sapiens
  Payload ID: 10048
  Gene Symbol: MME
  Gene Name: membrane metallo-endopeptidase
  ENST ID: ENST00000473730
  CDS Start-End: 613-892
tcaactggtataagaattgctgctttacattgctttgaaattaagcttacacttaaaatagtaatttattctgttggtaatattgtcgagctgaagtttgcaggttcttgttatcttagacctcctaattctctattctcgtctgtggcagtgtccacttttccgtttaaactttttatttaacacatcttcagttgaagtgaaatattttaagaatacaggtatgtttttgcgtaccctgctttatatgggactataagcctcaacttggtattttttttttttttgtattcttttgtttacttgtcccccttactcttctctatgggattgggtgtggttaagttggatattcaggtatttggggtttagtcatatgttccacagtgagattccagatactgtcccctgatgtcttaaagaaaaattgtgaaccttccagaattaactggaaatgaacgacaaagttaattaggagattaaacttgcatcatttctgcttttgctcaatgcttttgaaaaaaggctactaagagcaaaagacttcctttaagaatttacagggcatttacaagagggggagatggaggaagactttgcagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaac

SEQ ID NO: 152750 - DNA, 5523 bp, Homo sapiens
  Payload ID: 10048
  Gene Symbol: MME
  Gene Name: membrane metallo-endopeptidase
  Uniprot ID: P08473
  ENST ID: ENST00000615825
  CDS Start-End: 1-2253
atgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctg

SEQ ID NO: 152751 - DNA, 1315 bp, Homo sapiens
  Payload ID: 10048
  Gene Symbol: MME
  Gene Name: membrane metallo-endopeptidase
  ENST ID: ENST00000616757
  CDS Start-End: 457-696
gctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatggtgagttactcccacacctgtgcataagtgcaagcatggtagcacgcgcctataatcccagagggaggagaattgcttgaacccaggaggcagaggttgaagcgagccaagattgcacgactgcactccagcctggaagacagcgcaagactctatctccaaaaaaaagaaaaagacaacagagaattgaggggtctgcagaagcatatgttagaagtgtggtcctaaattatccagaggccagagaagccaagctaagacgtgatcaatacagtttacaagagaaagtgggaccacctccacctgtatagtcatgcaggttgtacactgcatatttgtcgatggcagccttgacagacaggcttgtggaacatcaagacctggatgaaacacctctcagaactgtccactccttttattttaattctgcacataccaagaaaacttttgatgattacttaattattaatacaaggagaggtggcattctgttacttgaaagatattttcatcatggtgagataatgcacagcggtccccttcttatcctctgaggatcccccaagacctcagtggatgtctgacactggactgaaccctatatatgctatattttttctgtatacatacctatgataaagtttaatttataaattagacaaagattaataacaataattaataaaaaataaaacgatt

SEQ ID NO: 152752 - DNA, 363 bp, Homo sapiens
  Payload ID: 10048
  Gene Symbol: MME
  Gene Name: membrane metallo-endopeptidase
  ENST ID: ENST00000625667
  CDS Start-End: 121-363
gagagcgccgagacgcgcggggcgcggagatgtgcaagtggcgaagcttgaccgagagcaggctggagcagccgcccaactcctggcgcgggatctgctgaggggtcacgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcaggcatggtagcacgcgcctataatcccagagggaggagaattgcttga

SEQ ID NO: 152753 - DNA, 2849 bp, Homo sapiens
  Payload ID: 10049
  Gene Symbol: MMEL1
  Gene Name: membrane metallo-endopeptidase-like 1
  Uniprot ID: Q495T6
  ENST ID: ENST00000378412
  CDS Start-End: 163-2502
actgctctcccatcccagtccctggaaatccacccacttggcccagctcaccccaactccaacccactgggacccagtctccaggggcctgactgtgggcggcagccactcctgagtgagcaaaggttcctccgcggtgctctcccgtccagagccctgctgatggggaagtccgaaggcccagtggggatggtggagagcgccggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggtgagcgaggtctgcaccacccctggctgcgtgatagcagctgccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagcggtgctggagaattcgactgccaaggaccggccggctgtggagaaggccaggacgctgtaccgctcctgcatgaaccagagtgtgatagagaagcgaggctctcagcccctgctggacatcttggaggtggtgggaggctggccggtggcgatggacaggtggaacgagaccgtaggactcgagtgggagctggagcggcagctggcgctgatgaactcacagttcaacaggcgcgtcctcatcgacctcttcatctggaacgacgaccagaactccagccggcacatcatctacatagaccagcccaccttgggcatgccctcccgagagtactacttcaacggcggcagcaaccggaaggtgcgggaagcctacctgcagttcatggtgtcagtggccacgttgctgcgggaggatgcaaacctgcccagggacagctgcctggtgcaggaggacatggtgcaggtgctggagctggagacacagctggccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggtgcagctagcggcgacccagtgtacgtcccgccccggccaaccatgccaagcctgcctgccaggcctctgcgcctggcctagggtgcagccacctgcctgacacccagggatgagcagtgtccagtgcagtacctggaccggagccccctccacagacacccgcggggctcagtgcccccgtcacagctctgtagagacaatcaactgtgtcctgcccaccctccaaggtgcattgtcttccagtatctacagcttcagacttgagctaagtaaatgcttcaaa

SEQ ID NO: 152754 - DNA, 1943 bp, Homo sapiens
  Payload ID: 10049
  Gene Symbol: MMEL1
  Gene Name: membrane metallo-endopeptidase-like 1
  Uniprot ID: Q495T6
  ENST ID: ENST00000502556
  CDS Start-End: 11-1879
agccctgctgatggggaagtccgaaggcccagtggggatggtggagagcgccggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggtgagcgaggtctgcaccacccctggctgcgtgatagcagctgccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagcggtgctggagaattcgactgccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggt

SEQ ID NO: 152755 - DNA, 2443 bp, Homo sapiens
  Payload ID: 10049
  Gene Symbol: MMEL1
  Gene Name: membrane metallo-endopeptidase-like 1
  Uniprot ID: Q495T6
  ENST ID: ENST00000504800
  CDS Start-End: 11-1846
agccctgctgatggggaagtccgaaggcccagtggggatggtggagagcgccggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggtgagcgaggtctgcaccacccctggctgcgtgatagcagctgccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagcggtgctggagaattcgactgccaaggaccggccggctgtggagaaggccaggacgctgtaccgctcctgcatgaaccagagtgtgatagagaagcgaggctctcagcccctgctggacatcttggaggtggtgggaggctggccggtggcgatggacaggtggaacgagaccgtaggactcgagtgggagctggagcggcagctggcgctgatgaactcacagttcaacaggcgcgtcctcatcgacctcttcatctggaacgacgaccagaactccagccggcacatcatctacatagaccagcccaccttgggcatgccctcccgagagtactacttcaacggcggcagcaaccggaaggtgcgggaagcctacctgcagttcatggtgtcagtggccacgttgctgcgggaggatgcaaacctgcccagggacagctgcctggtgcaggaggacatggtgcaggtgctggagctggagacacagctggccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgcttattctttgtcccgcccttggggacagtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggt

SEQ ID NO: 152756 - DNA, 552 bp, Homo sapiens
  Payload ID: 10049
  Gene Symbol: MMEL1
  Gene Name: membrane metallo-endopeptidase-like 1
  ENST ID: ENST00000471840
  CDS Start-End: 1-201
ggaggggtgcggcaagcctataaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggtgcagctagcggcgacccagtgtacgtcccgccccggccaaccatgccaagcctgcctgccaggcctctgcgcctggcctagggtgcagccacctgcctgacacccagggatgagcagtgtccagtgcagtacctggaccggagccccctccacagacacccgcggggctcagtgcccccgtcacagctctgtagagacaatcaactgtgtcctgcccaccctccaaggtgcattgtcttccagtatctacagcttcagacttgagctaagtaaatgcttcaaagaaa

SEQ ID NO: 152757 - DNA, 1943 bp, Homo sapiens
  Payload ID: 10049
  Gene Symbol: MMEL1
  Gene Name: membrane metallo-endopeptidase-like 1
  Uniprot ID: Q495T6
  ENST ID: ENST00000621908
  CDS Start-End: 11-1879
agccctgctgatggggaagtccgaaggccccgtggggatggtggagagcgctggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggtgagcgaggtctgcaccacccctggctgcgtgatagcagctgccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagcggtgctggagaattcgactgccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggt

SEQ ID NO: 152758 - DNA, 2849 bp, Homo sapiens
  Payload ID: 10049
  Gene Symbol: MMEL1
  Gene Name: membrane metallo-endopeptidase-like 1
  Uniprot ID: Q495T6
  ENST ID: ENST00000611357
  CDS Start-End: 163-2502
actgctctcccatcccagtccctggaaatccacccacttggcccagctcaccccaactccaacccactgggacccagtctccaggggcctgactgtgggcggcagccactcctgagtgagcaaaggttcctccgcggtgctctcccgtccagagccctgctgatggggaagtccgaaggccccgtggggatggtggagagcgctggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggtgagcgaggtctgcaccacccctggctgcgtgatagcagctgccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagcggtgctggagaattcgactgccaaggaccggccggctgtggagaaggccaggacgctgtaccgctcctgcatgaaccagagtgtgatagagaagcgaggctctcagcccctgctggacatcttggaggtggtgggaggctggccggtggcgatggacaggtggaacgagaccgtaggactcgagtgggagctggagcggcagctggcgctgatgaactcacagttcaacaggcgcgtcctcatcgacctcttcatctggaacgacgaccagaactccagccggcacatcatctacatagaccagcccaccttgggcatgccctcccgagagtactacttcaacggcggcagcaaccggaaggtgcgggaagcctacctgcagttcatggtgtcagtggccacgttgctgcgggaggatgcaaacctgcccagggacagctgcctggtgcaggaggacatggtgcaggtgctggagctggagacacagctggccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggtgcagctagcggcgacccagtgtacgtcccgccccggccaaccatgccaagcctgcctgccaggcctctgcgcctggcctagggtgcagccacctgcctgacacccagggatgagcagtgtccagtgcagtacctggaccggagccccctccacagacacccgcggggctcagtgcccccgtcacagctctgtagagacaatcaactgtgtcctgcccaccctccaaggtgcattgtcttccagtatctacagcttcagacttgagctaagtaaatgcttcaaa

SEQ ID NO: 152759 - DNA, 2443 bp, Homo sapiens
  Payload ID: 10049
  Gene Symbol: MMEL1
  Gene Name: membrane metallo-endopeptidase-like 1
  Uniprot ID: Q495T6
  ENST ID: ENST00000628503
  CDS Start-End: 11-1846
agccctgctgatggggaagtccgaaggccccgtggggatggtggagagcgctggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggtgagcgaggtctgcaccacccctggctgcgtgatagcagctgccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagcggtgctggagaattcgactgccaaggaccggccggctgtggagaaggccaggacgctgtaccgctcctgcatgaaccagagtgtgatagagaagcgaggctctcagcccctgctggacatcttggaggtggtgggaggctggccggtggcgatggacaggtggaacgagaccgtaggactcgagtgggagctggagcggcagctggcgctgatgaactcacagttcaacaggcgcgtcctcatcgacctcttcatctggaacgacgaccagaactccagccggcacatcatctacatagaccagcccaccttgggcatgccctcccgagagtactacttcaacggcggcagcaaccggaaggtgcgggaagcctacctgcagttcatggtgtcagtggccacgttgctgcgggaggatgcaaacctgcccagggacagctgcctggtgcaggaggacatggtgcaggtgctggagctggagacacagctggccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgcttattctttgtcccgcccttggggacagtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggt

SEQ ID NO: 152760 - DNA, 552 bp, Homo sapiens; identical to SEQ ID NO: 152756
  Payload ID: 10049
  Gene Symbol: MMEL1
  Gene Name: membrane metallo-endopeptidase-like 1
  ENST ID: ENST00000629675
  CDS Start-End: 1-201

SEQ ID NO: 152761 - DNA, 519 bp, Homo sapiens
  Payload ID: 10050
  Gene Symbol: MPP1
  Gene Name: membrane protein, palmitoylated 1, 55kDa
  ENST ID: ENST00000369531
  CDS Start-End: 126-519
cctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggagggaatcacgctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaa

SEQ ID NO: 152762 - DNA, 2042 bp, Homo sapiens
  Payload ID: 10050
  Gene Symbol: MPP1
  Gene Name: membrane protein, palmitoylated 1, 55kDa
  Uniprot ID: Q00013
  ENST ID: ENST00000369534
  CDS Start-End: 149-1549
gtccgcgccctcccggcgcaccgcctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcacgctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaa

SEQ ID NO: 152763 - DNA, 794 bp, Homo sapiens
  Payload ID: 10050
  Gene Symbol: MPP1
  Gene Name: membrane protein, palmitoylated 1, 55kDa
  ENST ID: ENST00000393529
  CDS Start-End: 71-794
agagagcagtcttcagcctgagacccactcctaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcacgctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctga

SEQ ID NO: 152764 - DNA, 1389 bp, Homo sapiens
  Payload ID: 10050
  Gene Symbol: MPP1
  Gene Name: membrane protein, palmitoylated 1, 55kDa
  Uniprot ID: Q00013
  ENST ID: ENST00000393531
  CDS Start-End: 25-1365
ttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcacgctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccact

SEQ ID NO: 152765 - DNA, 970 bp, Homo sapiens
  Payload ID: 10050
  Gene Symbol: MPP1
  Gene Name: membrane protein, palmitoylated 1, 55kDa
  ENST ID: ENST00000417435
  CDS Start-End: 155-424
agctccgtccgcgccctcccggcgcaccgcctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagagcttcctttgagcaactgcctctgccctttgaaccctgctgcagatgtttcctctgaaggggctttcagagcggcaggcattgccactccagcactttgtctgattaaaggccagaggctgcagaacaaaggccagacatggagtcctgggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcacgctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagc

SEQ ID NO: 152766 - DNA, 581 bp, Homo sapiens
  Payload ID: 10050
  Gene Symbol: MPP1
  Gene Name: membrane protein, palmitoylated 1, 55kDa
  ENST ID: ENST00000428488
  CDS Start-End: 113-581
gactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagagaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcaca

SEQ ID NO: 152767 - DNA, 2195 bp, Homo sapiens
  Payload ID: 10050
  Gene Symbol: MPP1
  Gene Name: membrane protein, palmitoylated 1, 55kDa
  Uniprot ID: Q00013
  ENST ID: ENST00000413259
  CDS Start-End: 394-1704
agctccgtccgcgccctcccggcgcaccgcctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagagcttcctttgagcaactgcctctgccctttgaaccctgctgcagatgtttcctctgaaggggctttcagagcggcaggcattgccactccagcactttgtctgattaaaggccagaggctgcagaacaaaggccagacatggagtcctgggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcacgctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgcc

SEQ ID NO: 152768 - DNA, 2066 bp, Homo sapiens
  Payload ID: 10050
  Gene Symbol: MPP1
  Gene Name: membrane protein, palmitoylated 1, 55kDa
  ENST ID: ENST00000439370
  CDS Start-End: 84-290
cttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggcaggtccccttgtgctatggtgcaaagagggtggccagtgtatatttgcgggtggaacaaggaatccagattccagggatggatggctggtaaatagctattaacctccgtcctcaaagatgccctaagggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcacgctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagg

SEQ ID NO: 152769 - DNA, 729 bp, Homo sapiens
  Payload ID: 10050
  Gene Symbol: MPP1
  Gene Name: membrane protein, palmitoylated 1, 55kDa
  ENST ID: ENST00000453245
  CDS Start-End: 113-729
gactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtacca

SEQ ID NO: 152770 - DNA, 4414 bp, Homo sapiens
  Payload ID: 10051
  Gene Symbol: MPP2
  Gene Name: membrane protein, palmitoylated 2 (MAGUK p55 subfamily member 2)
  ENST ID: ENST00000269095
  CDS Start-End: 306-1964
cttcccagtgggactccagcagggcgtcgtggtctgtgcggtgtctcccaaaccactacctggctgcccccgtaccagctgctgggaaagactacttcctccgagttgtgccggcctccgcgttctcctcacctcccctctcctccggacctccgccccctcgcggagaggccttgccgctttaagagccgggctagcgattgacaagcaataaacgctgagcgcccggctgcgctggagccgcccggagctaggggcttcccggggcgcaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagctagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtatgtgtgtgcgtgtgcacgtgcgtgtgtgtgtgtgtgtgtcaggtttaatttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaatgttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagctgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagcaaaggc

SEQ ID NO: 152771 - DNA, 4206 bp, Homo sapiens
  Payload ID: 10051
  Gene Symbol: MPP2
  Gene Name: membrane protein, palmitoylated 2 (MAGUK p55 subfamily member 2)
  ENST ID: ENST00000377184
  CDS Start-End: 47-1756
ggcggcgtgtaggacgctccgggagtccccgggtctgggggccgccatggcaggcagcccaggcagcggggtctccttggagggtatatccctggagtcttctgaggaagcggagctccagagggaagccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagctagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtatgtgtgtgcgtgtgcacgtgcgtgtgtgtgtgtgtgtgtcaggtttaatttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaatgttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagctgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagcaaaggc

SEQ ID NO: 152772 - DNA, 2111 bp, Homo sapiens
  Payload ID: 10051
  Gene Symbol: MPP2
  Gene Name: membrane protein, palmitoylated 2 (MAGUK p55 subfamily member 2)
  Uniprot ID: Q14168
  ENST ID: ENST00000520305
  CDS Start-End: 395-1636
aataaacgctgagcgcccggctgcgctggagccgcccggagctaggggcttcccggggcgcaggagagacgtttcagagcccttgcctccttcaccatgccggttgccgccaccaactctgaaactggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgt

SEQ ID NO: 152773 - DNA, 1896 bp, Homo sapiens
  Payload ID: 10051
  Gene Symbol: MPP2
  Gene Name: membrane protein, palmitoylated 2 (MAGUK p55 subfamily member 2)
  ENST ID: ENST00000518766
  CDS Start-End: 58-1851
ctttattagagagatacttgttgaccgacgaatgcagtggggcagccgctaagaataatgagttgggctccacctccccaggtgggccagaatctgagatcccagactgtcctgaggatcctaaatggaatggaagatttgatgtgggtcgctatggaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaa

SEQ ID NO: 152774 - DNA, 564 bp, Homo sapiens
  Payload ID: 10051
  Gene Symbol: MPP2
  Gene Name: membrane protein, palmitoylated 2 (MAGUK p55 subfamily member 2)
  ENST ID: ENST00000523762
  CDS Start-End: 145-564
ttgttgaccgacgaatgcagtggggcagccgctaagaataatgagttgggctccacctccccaggtgggccagaatctgagatcccagactgtcctgaggatcctaaatggaatggaagatttgatgtgggtcgctatggagccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctg

SEQ ID NO: 152775 - DNA, 3462 bp, Homo sapiens
  Payload ID: 10051
  Gene Symbol: MPP2
  Gene Name: membrane protein, palmitoylated 2 (MAGUK p55 subfamily member 2)
  ENST ID: ENST00000461854
  CDS Start-End: 87-1817
gagcgcccggctgcgctggagccgcccggagctaggggcttcccggggcgcaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggtgataatggtattgtggtttatgcagcagaatgtctttgttcctatgaaatacatgctgaaatactttggggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagctagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtatgtgtgtgcgtgtgcacgtgcgtgtgtgtgtgtgtgtgtcaggtttaatttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaa

SEQ ID NO: 152776 - DNA, 741 bp, Homo sapiens
  Payload ID: 10051
  Gene Symbol: MPP2
  Gene Name: membrane protein, palmitoylated 2 (MAGUK p55 subfamily member 2)
  ENST ID: ENST00000520406
  CDS Start-End: 289-741
gtcccccggcccccgggccagctcctatcccaagacctccgccttcttttcgtcctgacacggcacttaggaccctattcactgggtttaaactccacaggcccctttcacccaggcccgttccctccctgtccacccgcccccgcccctgggccctctttctggggtgctggttgggagaaccaagccccgctgcccattgacactggtccccgcccctgcggtaggggctccaaagtggcttcaggcaccaaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctg

SEQ ID NO: 152777 - DNA, 857 bp, Homo sapiens
  Payload ID: 10051
  Gene Symbol: MPP2
  Gene Name: membrane protein, palmitoylated 2 (MAGUK p55 subfamily member 2)
  ENST ID: ENST00000523220
  CDS Start-End: 289-857
ctgcctccctaacccttcccagtgggactccagcagggcgtcgtggtctgtgcggtgtctcccaaaccactacctggctgcccccgtaccagctgctgggaaagactacttcctccgagttgtgccggcctccgcgttctcctcacctcccctctcctccggacctccgccccctcgcggagaggccttgccgctttaagagccgggctagcgattgacaagcaataaacgctgagcgcccggctgcgctggagccgcccggagctaggggcttcccggggcgcagccatgcagcaagtcctggacaacttgggatccctccccagtgccacgggggctgcagagctggacctgatcttccttcgaggcattatggaaagtcccatagcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgc

SEQ ID NO: 152778 - DNA, 534 bp, Homo sapiens
  Payload ID: 10051
  Gene Symbol: MPP2
  Gene Name: membrane protein, palmitoylated 2 (MAGUK p55 subfamily member 2)
  ENST ID: ENST00000520241
  CDS Start-End: 104-534
gacaagcaataaacgctgagcgcccggctgcgctggagccgcccggagctaggggcttcccggggcgcaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggtacagtgctccagggaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgt

SEQ ID NO: 152779 - DNA, 543 bp, Homo sapiens
  Payload ID: 10051
  Gene Symbol: MPP2
  Gene Name: membrane protein, palmitoylated 2 (MAGUK p55 subfamily member 2)
  ENST ID: ENST00000518478
  CDS Start-End: 449-543
aggcgtcccccggcccccgggccagctcctatcccaagacctccgccttcttttcgtcctgacacggcacttaggaccctattcactgggtttaaactccacaggcccctttcacccaggcccgttccctccctgtccacccgcccccgcccctgggccctctttctggggtgctggttgggagaaccaagccccgctgcccattgacactggtccccgcccctgcggtaggggctccaaagtggcttcaggcaccaaggtggtgagctgtgaggggccccggtatctgcgcggcctccccgggggctgtgcgggttgggggtacttagaagcccggcattacggaaggaggacttctggagtcccttctctgaccctgtgagggagagcagcgccagccaggagaaggctccaggagagacgtttcagagcccttgcctccttcaccatgccggttgccgccaccaactctgaaactgccatgcagcaagtcctggacaacttgggatccctccccagtgccacgggggctgcagagctgga

SEQ ID NO: 152780 - DNA, 588 bp, Homo sapiens
  Payload ID: 10051
  Gene Symbol: MPP2
  Gene Name: membrane protein, palmitoylated 2 (MAGUK p55 subfamily member 2)
  ENST ID: ENST00000522172
  CDS Start-End: 369-588
aggtaggcgtcccccggcccccgggccagctcctatcccaagacctccgccttcttttcgtcctgacacggcacttaggaccctattcactgggtttaaactccacaggcccctttcacccaggcccgttccctccctgtccacccgcccccgcccctgggccctctttctggggtgctggttgggagaaccaagccccgctgcccattgacactggtccccgcccctgcggtaggggctccaaagtggcttcaggcaccaagggaaggaggacttctggagtcccttctctgaccctgtgagggagagcagcgccagccaggagaaggctccaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggaga

SEQ ID NO: 152781 - DNA, 545 bp, Homo sapiens
  Payload ID: 10051
  Gene Symbol: MPP2
  Gene Name: membrane protein, palmitoylated 2 (MAGUK p55 subfamily member 2)
  ENST ID: ENST00000521178
  CDS Start-End: 168-545
ataaacgctgagcgcccggctgcgctggagccgcccggagctaggggcttcccggggcgcagggaaggaggacttctggagtcccttctctgaccctgtgagggagagcagcgccagccaggagaaggctccaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccct

SEQ ID NO: 152782 - DNA, 2121 bp, Homo sapiens
  Payload ID: 10051
  Gene Symbol: MPP2
  Gene Name: membrane protein, palmitoylated 2 (MAGUK p55 subfamily member 2)
  ENST ID: ENST00000523501
  CDS Start-End: 66-1691
aataaacgctgagcgcccggctgcgctggagccgcccggagctaggggcttcccggggcgcagccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacc

SEQ ID NO: 152783 - DNA, 584 bp, Homo sapiens
  Payload ID: 10051
  Gene Symbol: MPP2
  Gene Name: membrane protein, palmitoylated 2 (MAGUK p55 subfamily member 2)
  ENST ID: ENST00000523934
  CDS Start-End: 139-584
aaagtggcttcaggcaccaaggtggtgagctgtgaggggccccggtatctgcgcggcctccccgggggctgtgcgggttgggggtacttagaagcccggcattacgagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggaga

SEQ ID NO: 152784 - DNA, 4351 bp, Homo sapiens
  Payload ID: 10051
  Gene Symbol: MPP2
  Gene Name: membrane protein, palmitoylated 2 (MAGUK p55 subfamily member 2)
  ENST ID: ENST00000536246
  CDS Start-End: 282-1907
gacctggtgccactcctcagggaatgtctgagtggaggctgcagtaccctgatggtggcctcttgggcacaagatctcagaggaatggggtcaccggagcggagctgagtccttcccttctgcccacacttttccctgtgtgcaaatgtgccctcatttttcctttctggggaactgagttccaagatgcctgacttgcttcctgggcatcatccccttcattaagaggaagaactcatgggagatgggggaggggaagaagctgctgtgaggcgagggccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagctagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtatgtgtgtgcgtgtgcacgtgcgtgtgtgtgtgtgtgtgtcaggtttaatttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaatgttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagctgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagc

SEQ ID NO: 152785 - DNA, 4938 bp, Homo sapiens
  Payload ID: 10051
  Gene Symbol: MPP2
  Gene Name: membrane protein, palmitoylated 2 (MAGUK p55 subfamily member 2)
  ENST ID: ENST00000612133
  CDS Start-End: 836-2494
ttctttttctcaatatggaagcaggataacgaggaaaagtgaggcacgcctggaactagaacgccggtctaagccaagatgggtgggcggagtaatcaagccggtctcattaggcacttttaccatcgcccctttaagggatccttgggagccgaggggcaccagcgggtactggtaccagtcctgcctccctaacccttcccagtgggactccagcagggcgtcgtggtctgtgcggtgtctcccaaaccactacctggctgcccccgtaccagctgctgggaaagactacttcctccgagttgtgccggcctccgcgttctcctcacctcccctctcctccggacctccgccccctcgcggagaggccttgccgctttaagagccgggctagcgattgacaagcaataaacgctgagcgcccggctgcgctggagccgcccggagctaggggcttcccggggcgcaggtaggcgtcccccggcccccgggccagctcctatcccaagacctccgccttcttttcgtcctgacacggcacttaggaccctattcactgggtttaaactccacaggcccctttcacccaggcccgttccctccctgtccacccgcccccgcccctgggccctctttctggggtgctggttgggagaaccaagccccgctgcccattgacactggtccccgcccctgcggtaggggctccaaagtggcttcaggcaccaagggaaggaggacttctggagtcccttctctgaccctgtgagggagagcagcgccagccaggagaaggctccaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagctagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtatgtgtgtgcgtgtgcacgtgcgtgtgtgtgtgtgtgtgtcaggtttaatttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaatgttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagctgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagc

SEQ ID NO: 152786 - DNA, 841 bp, Homo sapiens
  Payload ID: 10051
  Gene Symbol: MPP2
  Gene Name: membrane protein, palmitoylated 2 (MAGUK p55 subfamily member 2)
  ENST ID: ENST00000473246
  CDS Start-End: 284-841
gcgacctggtgccactcctcagggaatgtctgagtggaggctgcagtaccctgatggtggcctcttgggcacaagatctcagaggaatggggtcaccggagcggagctgagtccttcccttctgcccacacttttccctgtgtgcaaatgtgccctcatttttcctttctggggaactgagttccaagatgcctgacttgcttcctgggcatcatccccttcattaagaggaagaactcatgggagatgggggaggggaagaagctgctgtgaggcgagggccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccc

SEQ ID NO: 152787 - DNA, 4242 bp, Homo sapiens
  Payload ID: 10051
  Gene Symbol: MPP2
  Gene Name: membrane protein, palmitoylated 2 (MAGUK p55 subfamily member 2)
  ENST ID: ENST00000622681
  CDS Start-End: 173-1798
ttctgcaaggcctttattagagagatacttgttgaccgacgaatgcagtggggcagccgctaagaataatgagttgggctccacctccccaggtgggccagaatctgagatcccagactgtcctgaggatcctaaatggaatggaagatttgatgtgggtcgctatggagccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagctagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtatgtgtgtgcgtgtgcacgtgcgtgtgtgtgtgtgtgtgtcaggtttaatttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaatgttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagctgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagc

SEQ ID NO: 152788 - DNA, 592 bp, Homo sapiens
  Payload ID: 10051
  Gene Symbol: MPP2
  Gene Name: membrane protein, palmitoylated 2 (MAGUK p55 subfamily member 2)
  ENST ID: ENST00000524294
  CDS Start-End: 256-592
agcacatgcccaggaaggcaaagggaagaagggtggggggtaaccccctgccctctcctgggagaacgagggagccactcctagcctggggaggccctggaatggaaactggggctgtagactccatgcttggttctgcccagagcacttggtctccttgtgccagctctgagctaagaaagggagagaggagagagagccagccagaggggccgtggagaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaa

SEQ ID NO: 152789 - DNA, 4668 bp, Homo sapiens
  Payload ID: 10051
  Gene Symbol: MPP2
  Gene Name: membrane protein, palmitoylated 2 (MAGUK p55 subfamily member 2)
  ENST ID: ENST00000625880
  CDS Start-End: 503-2224
ttctttttctcaatatggaagcaggataacgaggaaaagtgaggcacgcctggaactagaacgccggtctaagccaagatgggtgggcggagtaatcaagccggtctcattaggcacttttaccatcgcccctttaagggatccttgggagccgaggggcaccagcgggtactggtaccagtcctgcctccctaacccttcccagtgggactccagcagggcgtcgtggtctgtgcggtgtctcccaaaccactacctggctgcccccgtaccagctgctgggaaagactacttcctccgagttgtgccggcctccgcgttctcctcacctcccctctcctccggacctccgccccctcgcggagaggccttgccgctttaagagccgggctagcgattgacaagcaataaacgctgagcgcccggctgcgctggagccgcccggagctaggggcttcccggggcgcaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggtacagtgctccagggaggtgggcacaagggcactcccccacctgttctgcttccacccccaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacattcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcaacaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtctttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgccccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagctagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtatgtgtgtgcgtgtgcacgtgcgtgtgtgtgtgtgtgtgtcaggtttaatttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaatgttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagctgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagc

SEQ ID NO: 152790 - DNA, 2182 bp, Homo sapiens
  Payload ID: 10052
  Gene Symbol: MPP3
  Gene Name: membrane protein, palmitoylated 3 (MAGUK p55 subfamily member 3)
  Uniprot ID: Q13368
  ENST ID: ENST00000398389
  CDS Start-End: 167-1924
ccagcggcggcccaggctctgggcactcgcgcggctcccgttcgcggagcacacatcccggcgcgacgaggttccttcggagagcgagcgggagtcggtgctcggcctcctgcggggagcagcccgaggaatctgcagggagaggtcgggaggtgacaacgccagcatgccagtgctatcggaggactctggtttgcatgaaaccctggccctgctgacctcccagctcagacctgactccaaccacaaggaggagatgggcttcctgagggatgttttcagtgaaaaaagcctcagttacttaatgaagattcatgagaagcttcgctattatgaaaggcaaagtccaaccccagttctgcacagcgctgtggccctcgctgaggacgtgatggaggagttgcaggccgcctccgtgcacagtgatgagagggagctgctccagctgctgtccaccccgcacctgagggctgtgctcatggtacatgacacggttgcccagaagaattttgaccccgttctcccgcctctgcctgacaatatcgatgaggattttgatgaggaatcggtgaagatcgtccgcttggtgaagaacaaggaacccctgggtgccaccatccggcgggacgagcactcaggggctgttgtggtggccaggatcatgcgaggaggcgcagcagacaggagcggcctggtccacgttggagatgagctccgagaagtgaacgggatcgcagtcctgcacaagcggcccgacgagatcagccagattctggcccagtcccagggatccatcaccctaaaaatcatcccagccacccaggaggaagatcgcttaaaggagagcaaggtgttcatgcgcgccctcttccactacaaccctcgggaggaccgggccatcccttgccaggaggcgggcctgcccttccagcgcaggcaggtcctggaggtggtgagccaggacgaccccacgtggtggcaggccaagcgagtcggggacaccaaccttcgagccggcctcatcccctccaaggggttccaggagagacgactaagctaccggagagccgcgggcaccctgccgagcccccagagcctcaggaagcccccctatgatcagccttgtgacaaagagacctgtgactgtgagggctacctcaaagggcactatgtggctggtcttcggaggagcttccggctgggctgtagggagagactgggtggctcgcaggaaggaaagatgtcctccggagctgagtctccggagctgctgacttacgaagaggtggccaggtaccaacaccagcccggagagcggccccgcctggtggttctgatcgggtctctgggagcccgactgcacgagctgaagcaaaaggtggtggctgagaacccacagcactttggcgtcgctgttccacataccaccaggccccgaaagagccatgagaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacacagcagccccatttgatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgttagttgggtcaggtaactttatcccagaacatccaagctggacgggaccttgaagatcatctagtccagactccctcattttaccatcaaggaatctcaagcgcagagagggagagaattctccacaaattccatcatcgagaagagtataagtgggaagtcttgtttgttgttggtttttgtctgttgtttttcactgcacctctttggatcatgatttgaaaggggcatatcagaaaacaacacatttcatttattaaagtatcacaggcaa

SEQ ID NO: 152791 - DNA, 2996 bp, Homo sapiens
  Payload ID: 10052
  Gene Symbol: MPP3
  Gene Name: membrane protein, palmitoylated 3 (MAGUK p55 subfamily member 3)
  ENST ID: ENST00000398393
  CDS Start-End: 262-2094
agcttccacgccgctgtttcttcatcaataaaatgggaacattcgcagtcatttctcaggactttgtgcagacaaaaagtttatcatagaaatcaccccacacaatgcttggcacatcgaggacactcagcacatcttagctttatttccttcctctctgaaaaaagtaagcagagttatttgttcccatcctctctgtccacagcctggtctcagagaacacagtagatgtgtagtcagtttgttcaataaatatgcttgatggagcttcaatacccacctccacccccttctcccagaatctgcagggagaggtcgggaggtgacaacgccagcatgccagtgctatcggaggactctggtttgcatgaaaccctggccctgctgacctcccagctcagacctgactccaaccacaaggaggagatgggcttcctgagggatgttttcagtgaaaaaagcctcagttacttaatgaagattcatgagaagcttcgctattatgaaaggcaaagtccaaccccagttctgcacagcgctgtggccctcgctgaggacgtgatggaggagttgcaggccgcctccgtgcacagtgatgagagggagctgctccagctgctgtccaccccgcacctgagggctgtgctcatggtacatgacacggttgcccagaagaattttgaccccgttctcccgcctctgcctgacaatatcgatgaggattttgatgaggaatcggtgaagatcgtccgcttggtgaagaacaaggaacccctgggtgccaccatccggcgggacgagcactcaggggctgttgtggtggccaggatcatgcgaggaggcgcagcagacaggagcggcctggtccacgttggagatgagctccgagaagtgaacgggatcgcagtcctgcacaagcggcccgacgagatcagccagattctggcccagtcccagggatccatcaccctaaaaatcatcccagccacccaggaggaagatcgcttaaaggagagcaaggtgttcatgcgcgccctcttccactacaaccctcgggaggaccgggccatcccttgccaggaggcgggcctgcccttccagcgcaggcaggtcctggaggtggtgagccaggacgaccccacgtggtggcaggccaagcgagtcggggacaccaaccttcgagccggcctcatcccctccaaggggttccaggagagacgactaagctaccggagagccgcgggcaccctgccgagcccccagagcctcaggaagcccccctatgatcagccttgtgacaaagagacctgtgactgtgagggctacctcaaagggcactatgtggctggtcttcggaggagcttccggctgggctgtagggagagactgggtggctcgcaggaaggaaagatgtcctccggagctgagtctccggagctgctgacttacgaagaggtggccaggtaccaacaccagcccggagagcggccccgcctggtggttctgatcgggtctctgggagcccgactgcacgagctgaagcaaaaggtggtggctgagaacccacagcactttggcgtcgctgttccacataccaccaggccccgaaagagccatgagaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacacagcagccccatttgatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgttagttgggtcaggtaactttatcccagaacatccaagctggacgggaccttgaagatcatctagtccagactccctcattttaccatcaaggaatctcaagcgcagagagggagagaattctccacaaattccatcatcgagaagagtataagtgggaagtcttgtttgttgttggtttttgtctgttgtttttcactgcacctctttggatcatgatttgaaaggggcatatcagaaaacaacacatttcatttattaaagtatcacaggcaagctgaccctgattctttgtaccaaagttaagtagccactgtcttttgtgggtggtagtggttaatttatacagtactgattcgcagaatgtttaagctttttaaacatagtgacgcttagtagtttttttggaagctaacttgttttatccaaggggattttacatgtaactgaagttcccctgtcttcaagcactaaaacgttgatcttaaccttttttttgaagtgcttgcctggtaatagaaaacgggttctctgcctattttaaaatagtgaatatacgtaaattttctctggaaggctgaggcacacttcaccatcaacatgaattactgtactatcctgtactgcagtggtgccttcagggactcgaggaatgtaaggttgcctttcccctttctaaataccctcagattcctaacatcgagcccatgctttgtttgatttgttctattccatccattgtcccttttgttactgacagttgccttggtcctagccagtccctgccatgagatcataggggttcccattgtgctagatcttgggaaaccagatgactctccctgtcaaaactatggctacgtcactgtaaaccatttctgtcaagaataaaagtatgtagacccagagtgtgggcctaa

SEQ ID NO: 152792 - DNA, 2186 bp, Homo sapiens
  Payload ID: 10052
  Gene Symbol: MPP3
  Gene Name: membrane protein, palmitoylated 3 (MAGUK p55 subfamily member 3)
  ENST ID: ENST00000496503
  CDS Start-End: 167-1114
ccagcggcggcccaggctctgggcactcgcgcggctcccgttcgcggagcacacatcccggcgcgacgaggttccttcggagagcgagcgggagtcggtgctcggcctcctgcggggagcagcccgaggaatctgcagggagaggtcgggaggtgacaacgccagcatgccagtgctatcggaggactctggtttgcatgaaaccctggccctgctgacctcccagctcagacctgactccaaccacaaggaggagatgggcttcctgagggatgttttcagtgaaaaaagcctcagttacttaatgaagattcatgagaagcttcgctattatgaaaggcaaagtccaaccccagttctgcacagcgctgtggccctcgctgaggacgtgatggaggagttgcaggccgcctccgtgcacagtgatgagagggagctgctccagctgctgtccaccccgcacctgagggctgtgctcatggtacatgacacggttgcccagaagaattttgaccccgttctcccgcctctgcctgacaatatcgatgaggattttgatgaggaatcggtgaagatcgtccgcttggtgaagaacaaggaacccctgggtgccaccatccggcgggacgagcactcaggggctgttgtggtggccaggatcatgcgaggaggcgcagcagacaggagcggcctggtccacgttggagatgagctccgagaagtgaacgggatcgcagtcctgcacaagcggcccgacgagatcagccagattctggcccagtcccagggatccatcaccctaaaaatcatcccagccacccaggaggaagatcgcttaaaggagagcaaggtgttcatgcgcgccctcttccactacaaccctcgggaggaccgggccatcccttgccaggaggcgggcctgcccttccagcgcaggcaggtcctggaggtggtgagccaggacgaccccacgtggtggcaggccaagcgagtcggggacaccaaccttcgagccggcctcatcccctccaaggggttccaggagagacgactaagctaccggagagccgcgggcaccctgccgagcccccagagcctcaggaagcccccctagacctgtgactgtgagggctacctcaaagggcactatgtggctggtcttcggaggagcttccggctgggctgtagggagagactgggtggctcgcaggaaggaaagatgtcctccggagctgagtctccggagctgctgacttacgaagaggtggccaggtaccaacaccagcccggagagcggccccgcctggtggttctgatcgggtctctgggagcccgactgcacgagctgaagcaaaaggtggtggctgagaacccacagcactttggcgtcgctgttccacataccaccaggccccgaaagagccatgagaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacacagcagccccatttgatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgttagttgggtcaggtaactttatcccagaacatccaagctggacgggaccttgaagatcatctagtccagactccctcattttaccatcaaggaatctcaagcgcagagagggagagaattctccacaaattccatcatcgagaagagtataagtgggaagtcttgtttgttgttggtttttgtctgttgtttttcactgcacctctttggatcatgatttgaaaggggcatatcagaaaacaacacatttcatttattaaagtatcacaggcaagctgaccctgattctttgtaccaaa

SEQ ID NO: 152793 - DNA, 488 bp, Homo sapiens
  Payload ID: 10052
  Gene Symbol: MPP3
  Gene Name: membrane protein, palmitoylated 3 (MAGUK p55 subfamily member 3)
  ENST ID: ENST00000479797
  CDS Start-End: 1-63
ggggacaccaaccttcgagccggcctcatcccctccaaggggttccaggagaggcgattctgagatgccgaagtctgagaacgaagctctgtctcctcgggaaccccagacccatctccattttagggttcacagacgactaagctaccggagagccgcgggcaccctgccgagcccccagagcctcaggaagcccccctagacctgtgactgtgagggctacctcaaagggcactatgtggctggtcttcggaggagcttccggctgggctgtagggagagactgggtggctcgcaggaaggaaagatgtcctccggagctgagtctccggagctgctgacttacgaagaggtggccaggtaccaacaccagcccggagagcggccccgcctggtggttctgatcgggtctctgggagcccgactgcacgagctgaagcaaaaggtggtggctgagaacccacagcactttggcgtcgctgttccac

SEQ ID NO: 152794 - DNA, 2330 bp, Homo sapiens
  Payload ID: 10053
  Gene Symbol: MPP4
  Gene Name: membrane protein, palmitoylated 4 (MAGUK p55 subfamily member 4)
  Uniprot ID: Q96JB8
  ENST ID: ENST00000315506
  CDS Start-End: 209-1990
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaataaaataagcaatagttaactttagaaa

SEQ ID NO: 152795 - DNA, 2436 bp, Homo sapiens
  Payload ID: 10053
  Gene Symbol: MPP4
  Gene Name: membrane protein, palmitoylated 4 (MAGUK p55 subfamily member 4)
  ENST ID: ENST00000359962
  CDS Start-End: 209-2101
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatcaatttctatggaagaagaagatgacatgaagattgatgagaaatgtgtggaagcagaggaactttcagaagacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaataaaataagcaatagttaacttt

SEQ ID NO: 152796 - DNA, 2250 bp, Homo sapiens
  Payload ID: 10053
  Gene Symbol: MPP4
  Gene Name: membrane protein, palmitoylated 4 (MAGUK p55 subfamily member 4)
  ENST ID: ENST00000396886
  CDS Start-End: 227-1915
agtccggaattgcatgtggtgggtgcttacttatttgcagtctcaatcaagaattctcactctcaagatagcagaaatagataagcttcaactgacaaatttggtacagaagtcatggaaaggaagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaagggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaataaaataagcaatagttaacttt

SEQ ID NO: 152797 - DNA, 1760 bp, Homo sapiens
  Payload ID: 10053
  Gene Symbol: MPP4
  Gene Name: membrane protein, palmitoylated 4 (MAGUK p55 subfamily member 4)
  ENST ID: ENST00000409818
  CDS Start-End: 62-1366
gactttggcagctaacaggccactagtatcctactaaagcttttgtctggataggagcaacatgcatgtttacagtcttgcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatttctgggatacatgtgcagaacgtgcagcaatttctatggaagaagatggagtttcgctcttgttgcccaggctggagtgcaatggcactatctcgactcactgcaacctctgcctcccgggttcaaacgattctcctgcctcagcctcccacgtagctgggattatatagaagatgacatgaagattgatgagaaatgtgtggaagcagctcctgctgcacccctgactgtcatcatggctcaactgccgaataccatgtgtttcatgtaaagctgatatatgccatagagacaccatcgattcgaccttgatttaggaaaaaaactttacaaagatgaagaaacatttgaatctgaggaactttcagaagacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccac

SEQ ID NO: 152798 - DNA, 2462 bp, Homo sapiens
  Payload ID: 10053
  Gene Symbol: MPP4
  Gene Name: membrane protein, palmitoylated 4 (MAGUK p55 subfamily member 4)
  Uniprot ID: Q96JB8
  ENST ID: ENST00000409474
  CDS Start-End: 209-2122
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatcaatttctatggaagaagaagatgacatgaagattgatgagaaatgtgtggaagcagatgaagaaacatttgaatctgaggaactttcagaagacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaataaaataagcaatagttaactttagaaa

SEQ ID NO: 152799 - DNA, 2082 bp, Homo sapiens
  Payload ID: 10053
  Gene Symbol: MPP4
  Gene Name: membrane protein, palmitoylated 4 (MAGUK p55 subfamily member 4)
  ENST ID: ENST00000409143
  CDS Start-End: 238-1977
tctgtgtactcagtccggaattgcatgtggtgggtgcttacttatttgcagtctcaatcaagaattctcactctcaagatagcagaaatagataagcttcaactgacaaatttggtacagaagtcatggaaaggaagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactt

SEQ ID NO: 152800 - DNA, 2050 bp, Homo sapiens
  Payload ID: 10053
  Gene Symbol: MPP4
  Gene Name: membrane protein, palmitoylated 4 (MAGUK p55 subfamily member 4)
  ENST ID: ENST00000447335
  CDS Start-End: 104-1996
cagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatcaatttctatggaagaagaagatgacatgaagattgatgagaaatgtgtggaagcagaggaactttcagaagacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatcca

SEQ ID NO: 152801 - DNA, 2320 bp, Homo sapiens
  Payload ID: 10053
  Gene Symbol: MPP4
  Gene Name: membrane protein, palmitoylated 4 (MAGUK p55 subfamily member 4)
  ENST ID: ENST00000428900
  CDS Start-End: 166-2007
ctcaagatagcagaaatagataagcttcaactgacaaatttggtacagaagtcatggaaaggaagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatatgaagaaacatttgaatctgacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaat

SEQ ID NO: 152802 - DNA, 540 bp, Homo sapiens
  Payload ID: 10053
  Gene Symbol: MPP4
  Gene Name: membrane protein, palmitoylated 4 (MAGUK p55 subfamily member 4)
  ENST ID: ENST00000602867
  CDS Start-End: 26-540
aagcttttgtctggataggagcaacatgcatgtttacagtcttgcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaa

SEQ ID NO: 152803 - DNA, 2364 bp, Homo sapiens
  Payload ID: 10053
  Gene Symbol: MPP4
  Gene Name: membrane protein, palmitoylated 4 (MAGUK p55 subfamily member 4)
  ENST ID: ENST00000620095
  CDS Start-End: 209-2029
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggcctctcccagatcctgaggcttgtgctgcaagagctgagtctgttctacggcagagatgtgaatggagtgtgtctcttgtacgatctcctccactcgccgtggcttcaggctctgctaaagatttatgactgcctccaggaatttaaagaaaagaaactagttcctgccacaccacatgcacaggtgttatcctatgaggtagtggagttattacgtgaaacccctacttcccctgagatccaagagctgagacaaatgctccaggctccacacttcaaggccttgctcagtgcccatgacacgatagctcagaaagattttgaaccccttctccctccactgccagacaatatccctgagagtgaggaagcaatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaagcaacgggaattctggtggtctcagccgtaccagcctcacacctgcctcaagtcaaccctatacaaggaggagtttgttggctacggtcagaagttctttatagctggcttccgccgcagcatgcgcctttgtcgcaggaagtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggaccctctggtgttggagtaaatgagctcagaagacaacttattgaatttaatcccagccattttcaaagtgctgtgccacacactactcgtactaaaaagagttacgaaatgaatgggcgtgagtatcactatgtgtccaaggaaacatttgaaaacctcatatatagtcacaggatgctggagtatggtgagtacaaaggccacctgtatggcactagtgtggatgctgttcaaacagtccttgtcgaaggaaagatctgtgtcatggacctagagcctcaggatattcaaggggttcgaacccatgaactgaagccctatgtcatatttataaagccatcgaatatgaggtgtatgaaacaatctcggaaaaatgccaaggttattactgactactatgtggacatgaagttcaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttcttgtttaatgctggagttttaacactgtacccttgatacagcgatccatagttgcaatctaaaacaacagtatttgacccattttaatgtgtacaactttaaaagtgcagcaatttattaattaatcttatttgaaaaaaatttttattgtatggttatgtggttacctattttaacttaattttttttcctttacctcatatgcagctgtggtagaaatatgaataatgttaagtcactgagtatgagaacctttcgcagatttcacatgatctttttaagatttaaataaagagctttcctaaataaaataagcaatagttaacttt

SEQ ID NO: 152804 - DNA, 5552 bp, Homo sapiens
  Payload ID: 10054
  Gene Symbol: MPP5
  Gene Name: membrane protein, palmitoylated 5 (MAGUK p55 subfamily member 5)
  Uniprot ID: Q8N3R9
  ENST ID: ENST00000261681
  CDS Start-End: 662-2689
gttttagacttagaggcgcgcgactgcgcgcacccggctggagctgcggagaggaccaatgagcgggcgctctctccgctccggctcgggattgggcaagccgcgccagcctctcacgggcggggtgggactcggatccgcgcgcccactgcgccagagtcccgggggcgcgtgcgcggtctcgcggcggccgcaggggccggtctcgcgcggtctagaagtggagttgctggcggctgcggcggtgacggcggcgacggaggaggcaggcggtggggcgggggcggggactaaggattctgaggtggggagtcgggagtttctggattctttatccggaatttcaagggccgccggagggctgtcgcttctgcagtgcgtaggagcggccggggcgggaggctccgcggagccgaggcgtggagaataagaaagccttgagttttgtgaaaaaccggagaagagaaactaaaaggacagtagaaaaggcttttccagtttgcataatatttccttcatggatactttttcatagcattattatgtgatgtgagaagtttttttttttgaagtaacatggattttatactacagaatcaagagaattggcttataggaaaaattgatttataaaaagtggtacaggttttcatagataaccatgacaacatcccatatgaatgggcatgttacagaggaatcagacagcgaagtaaaaaatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactgtggccagaatgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaagcca

SEQ ID NO: 152805 - DNA, 1163 bp, Homo sapiens
  Payload ID: 10054
  Gene Symbol: MPP5
  Gene Name: membrane protein, palmitoylated 5 (MAGUK p55 subfamily member 5)
  ENST ID: ENST00000556345
  CDS Start-End: 348-722
gggagtttctggattctttatccggaatttcaagggccgccggagggctgtcgcttctgcagtgcgtaggagcggccggggcgggaggctccgcggagccgaggcgtggagaataagaaagccttgagttttgtgaaaaaccggagaagagaaactaaaaggacagtagaaaaggcttttccagtttgcataatatttccttcatggatactttttcatagcattattatgtgatgtgagaagtttttttttttgaagtaacatggattttatactacagaatcaagagaattggcttataggaaaaattgatttataaaaagtggtacaggttttcatagataaccatgacaacatcccatatgaatgggcatgttacagaggaatcagacagcgaagtaaaaaatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattaggtaagtaaaaatagaggtataacagaaaacattttgctttaatttatctgtgccttataatgtatatgagaaggaagagggtttaagagaatgtaagtaatgacagtttgaattccagaccaagatcctttgttttcgtggaaacgccgtataactattgtttactgttaccaacatagagctaaaagcatgtggcttaaatgttaagtcactataacatgtttttttagatattaaagagttctgcatgggccctaacatttaaagccttgaaatttaccttttatatcaaaccacaaactttatgcaaaatactaaaaaagaattttcagattttgaatttctgatttccttaaagttttgtaaaatagtaataaatttgtaactacagtttaaattctttgatttttttaaattaatgattgtcaataaaaagaactggtattgtt

SEQ ID NO: 152806 - DNA, 567 bp, Homo sapiens
  Payload ID: 10054
  Gene Symbol: MPP5
  Gene Name: membrane protein, palmitoylated 5 (MAGUK p55 subfamily member 5)
  ENST ID: ENST00000557783
  CDS Start-End: 120-567
ctttatccggaatttcaagggccgccggagggctgtcgcttctgcagtgcgtaggagcggccggggcgggaggctccgcggagccgaggcgtggagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatct

SEQ ID NO: 152807 - DNA, 5006 bp, Homo sapiens
  Payload ID: 10054
  Gene Symbol: MPP5
  Gene Name: membrane protein, palmitoylated 5 (MAGUK p55 subfamily member 5)
  Uniprot ID: Q8N3R9
  ENST ID: ENST00000555925
  CDS Start-End: 218-2143
gggagtttctggattctttatccggaatttcaagggccgccggagggctgtcgcttctgcagtgcgtaggagcggccggggcgggaggctccgcggagccgaggcgtggagaataagaaagccttgagttttgtgaaaaaccggagaagagaaactaaaaggacagtagaaaaggcttttccagtttgcataataggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactgtggccagaatgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaagggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatatgtcgcctttttctgttcaaatttgcatggcctattaagttggctggagagtgttttatgtggaaatattttcaagataatgttccttaggaagaaaataacattcttgggttgagggaaggaatgccatacactactgtctcttcagatctgaaatactccagtttagagccaggaaatttcacaggtcacaccgatttttagcattaaaaactaaggaatatacttagcacttacttaatcttttcagttttccagtttacgtctcaggaatgaagtgtagtctatggttgacaatggagttttgtgatcctgcttattgtaactgacaactgttttcaactccaagagctaaactattggcagttcatgttaagttagagtgagggtgtaggtagtgtcagtgagtggctcttgtgcctgctgtagacattaggcctgcactagggccatgtgctgtcaagattcaggaacatggctttaacaagcagatcttgtatcaaggcagaggtgatgccatgccatacttttaggaagtctgagatgataaatatttcaaggtcagtgaagtctatcaatcattctccccttcctcatcagcaatggtagatagaaatgtcctaaacttttctaaatcctagtgatgaggatgtgctgatattcaacatagtccttaaagtgaaaactgagttgttgctgacctccacaaaagaatatggaaaaaagccttgctgtacacctagttgtacagccactctggccaattccatttcctgtccctctgtggttctgactggagaccccagtgtgggggaggtcttaccatttaatatagaaatgatatcaataactaatgctatgtacttggaaaatccaaataaggaagttttaggttggtgcataactttgtttctcaaattttcgttgtcagaacaaatggaaggagaatattatttagactaatccagatttgctttctatgaaaatctaatgtctggattatcttccttttctcatggcctaagaaataaggatcaataaggaatgatttgaatgtaattttgtgaatgtgtggaaaatataaagcagggatttagccttaataaaggtaaccttctgacatctgttgttaatccccctttgtactcttttcctgtatctgcactgttattttgagatgtcatactgtacactgtattgtaaaaataaaaagtaaaattatatttcaaattttaaaagcca

SEQ ID NO: 152808 - DNA, 479 bp, Homo sapiens
  Payload ID: 10054
  Gene Symbol: MPP5
  Gene Name: membrane protein, palmitoylated 5 (MAGUK p55 subfamily member 5)
  ENST ID: ENST00000557237
  CDS Start-End: 466-479
cttcccccacacgctgcgcaaactccggccagcgggagacccctggcagccaggcgggcttcctcaggcgcgcgagctgcggccgtggagggtgtgagcccaacctttgtccctcggagcaacgctgcctgcgcggtgcccgctccttctgcttggctgggcatgcaccttggcgcgggccacagccagccgagcccgaggtgcagggggcgcggcggggagtcgtctgccccctgcgccctctctccgaggtcgcgacgcgcgggactctcccggccgggtctgggaaatcggcgagggaacgctttcctttagaagtcagaatgtagtcagcgttcctctgcctgactcagctgctgaataagaaagccttgagttttgtgaaaaaccggagaagagaaactaaaaggacagtagaaaaggcttttccagtttgcataataggaacatcagaagcaccgagagatggctgttgactg

SEQ ID NO: 152809 - DNA, 8452 bp, Homo sapiens
  Payload ID: 10055
  Gene Symbol: MPP6
  Gene Name: membrane protein, palmitoylated 6 (MAGUK p55 subfamily member 6)
  Uniprot ID: Q9NZW5
  ENST ID: ENST00000222644
  CDS Start-End: 251-1873
ggctggctgcgcgcgcggaggcagcggcgggggcgaccggagctggggcagagtggggagcgagggagggggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaagcattttgtatatgttttgatttagtacccttgcctttttcatcaaaggaattttcaaatcattcactctaacattggtctcatattttcactgtgataatgaatattacttgaaatagttttgtaaagctgtcatttagttcagtattcaaatagtgaagggttagtcttaatagaagaaaatatagttattgaccttccttcttataaatttcttacaaaagcagaattttaagtcagtgttatagctagtctactaccatctaaatctgacatcaaaagtctgatcagtttacgtattttcattatttcggagatgtatggctatccattctaatttatacagctatattagttttgtctcttcatttctatctttactgaaaaattgaagagcaataccttgcactctcttttgaggttattctttttatttgttgcagtgatatgatgctaactaatttaacatgtacacagtaagctctggggctggaagcaaggtcatgcagactgagagagtgccttatcctgtaaaaccttacagcaaaatgacacttgaagaaagtttattttcacatgtaaaattttgactgacaaaaggaacctactactttaaacaatggttttattagaacatggtcagcaaatgtatcatgcctctgcaaattttagtgatgtttagagatgcctctaagtttgcagttggaggtttttgtgcttttagaaatgtgatgtgatccttagggtacctgttttgtctgttgtgttgagaaccaaacccattgaacaacttaaaaaattgggaaataattgtcagctattttgtatacatacacacaaaatatatacattatataatatgtatattatgtattatataatatatataaaatgttttgtatattttttacatatctgttaaaaaatgtactttgtttttttgtttgtttgttttgagatggagtctctctctgtcacccatgctggagtacagtggcgcgatctcagcccgctgcaacctctgcctcctgggttcatgcgactctcgtgcctcagcctcccaagtaattgagattacagttgggtgccaccatgtccggctaatttttgtatttttagtacagatggggtttcaccatgttggccagggtggtctcgagctcctgacctcaagtgatccacccaccttggcctcccaaagtgctgagattacaagcatgagccactgcacctagccaagaagtgtactttttgtttaatgattaccgaaagaagttctcctttagaagcattgacttatacaaattcccacattcacctcagttaatatcttcctttaggattcttggataatagaaattcttcctaaaacatactcagagatgcagctcattattaaattaaggtaaccacattctgtattgttgctagcttttcatgtaaacattattcacactttaaaggattaggtgtttaaatattgatggtcatctttgtctggtgttaggtgccagacacctggctgctgaatttgttttttccctcaccaaagttgtcatttggaacgccagctgggaggactttgaaggaaaagaaaatatatgacaataggcagtattgacacattgtttaaaatctttttcacaataaaacaaaacacccaagttgtcatattgttaaagttggaaatctataggtttttctttttttttttttttttctttttttgattctagatttcatggccagaacacaaattcacgtttcttgtcctaggacagggaattggtgacaaaatggattatactattttaataacagtggaaactttcaaactacatgtgtttacaccaaattcttggcttctcaaagcaacatgaattaaagcacagtatcaaggtgatgccctatgacaatgtttcaacacacacttgaaattttaagagaaatttcagttcttcactcaggaaatgtgctgtattctctaatgtactttcatgctgcagcatggagcctctttaaacagctttgggataattatagcagcacaagaagtttatctgcaaaatatttcaatcatcttggtacaatagatgacttttacatcatgtatattagccttatgtgatataaaatgtattacttagaaaatatacttaaaggaattatttctattataaatggtattcatgattgactacttaattaatgcacattagatttctcctaatataaaatgaaatgatgcagtttagttcatttcagtctagatgcccgtactaacaagaatacagttagataagttcattgtatctcaatgaagaatcattgaacttgaaacccaagtcccaaatgaatctgcaggaatgagcagtgctctgcgggggcaaacagccccagaggtcccagggttcttcctaggtaatgagagtatagctgtgatcaaggaaatgtgaacttctcttttgggaagatctgcgataattagctttatggaagcgaaaatggtttagagtggtgttgagcaattgttaagagttgaaatagacacacacatgcatgtgcttttgggaaacatgatgtgccaacgtattaatgtgcctgagggctccttgtggataggtcagtgtccacatttcagcactcagggcatgactgtacacaacctaagactatatatatattttttcattttcaaatgtacaaatacccatagaggtgatgtgcctggataagtcatttaaccatagcttagtgaaataaatgtgatggccctaaaaagtagaattttcactttcattacagccatgcctttattatgcagtctccatttctgtgtgatatttggtaatatcacatgtcaaatacatcaggactttgtttattttggctaactctaactatacaattgctgaacatagctttctgaaatagaaattataagagaaacccagtatgcctacagcattagtagcctaaatcctagattctagaatccaataaatttatagtagttcttaagaagtttcctttaaagcaacaaatagattattaaggcaaatttagataataacccaagttagcaataaaaccatgtgacattatagattatgtccagatactaactgctttgaccataatatcccaatgacaataaaaaatgatccttggtttaaaaattattaaatggtacttatttttatgtataacaagtgtcatgatcccagtgactggagttgattttcaaggtggatagccatagagttaggtaaaattattttgaattggcaaactaaagataacaattttgaaaattgctcaaaataataatctacttaaattttacttttgtaacttctgaaacagtactccattatccagaaatcacaggctagagagccaataattttgtagtaatgaaccttaactaaacatgaaaaaggcaatcctgaagttttatgtacatagatagcagttcattttttaaatgttcgagttgccatatattatgtatgtgtgtgtgtgtgtgtatatatatatatatatatatatatatatatatatatatacagctatgtgtataatatgtaaaattctcccaaaatgtatgaatataaaactgaatgtattcattcatgtaattataactagcattctaaaatttttaattactcccatttctttgacattctgaaactttttttagattgttttaaaacgctctggttccaccttgaagctgataatctttctgaaaaatatatgagaaactcagaaagtagtcattattataataaatttaattttcttagggaaaaagggcagggttctggatggaaacccctttggaaattcttatttaaacttttgaatgaatctttaatatgattcaggctgagattatgatacctgcccttgtcttatttcaagaggtttgctgtgagaattcatgtaataacatctgtaatgtatttggaatttttgggagaaattcattcttttaaataatgggattattgtatatagtacaaatgaatactcacaaaatttaagaatacatttgactaataattgagcatcttgtcagtttttatgcaagcatatattgtatacctgaggaagatgacagttctataatttttttaaggtaaggttatttttaaattgcatttttgttctaacgttttgcaatttatattctttttaaaatatttcccataattcatcatgctagcttctgtgttcttggaatagtttttgaaaaatgcagagattcgaacatgagtccttaatatactaaacagtgaaagaatgatgatatctcatttctaaagtaagcatggttcacaccactttggcaatacactgcagtactttttaaaaaatattctctagtgataaaagtaaagacagggtactggccaagatcctaattctgacttctgactgtgtgatcttcgatgaaatttatatttccctttatcattactattctacttgttaagtaaggctaagttaatatttgtcttcgccttaaattctgatttgtaatttgtaactctgatgtggtagctgtgatatggtgaactgaaaaatccttattaggctactttatctgttctcttttagttattttaaagtgtacctgtttctgaagtaatgtagtgaatggtgaatacttttcaggaattcttccagttttaaaatagccccaaagatacagtttcagctggtggaaggtctgttctgctctcttagtcctaatcagaaagtcccttttatcttataatcccatactaaatccaaacccttagcaaatccttgctgccaaccagaccactcacaaatcaaacaaaatgtaagcaagcaatccagtactcggttacaccagaagactctgatctttgcccccgaaaactgtcctactttatccttatacctgaaatcactgcatacctgaaatcactgcagccctactgttttacccataccattaatttaaaaaggcatctatttctttatagaaagaaacattcacagtgaggtcttagtttgtgaacctcaaaatccagatattaatccactttagttattactttgtaattgcttctcagtcattggctgataatgcaatggtgtgataaatttgacttatctccacatacaaaagtcgatcagaagggatagttctcttcctttttttcccctcctactggctcttactgttttctaatctccagtgtaaatggaatgaacacatctatagttaaggtaaatgccaccaatcagaagattgagtgatttactgcttgtaaagcaactgtctttgaatcttatgaaataggtggtgttgctaccacagaagccaaaaaggtcttaaaattggaaatagatgtctttattgtacttcagccaacagcaagccaggggaaggaacatacataaatatgacaggtcatatatgaaatttggctctcctcctatcaaagtagcctaggagcttggaggaagcctaattaactaaaacaggaaaaaagcatactcatctgatgtaaaaactcatcagctgtaaattaccaacattaaaccagaagtcattaccagttaaaatgtgtggttttcatcttattcttaaataggagaggtggacagtagtgtaagtaacattgctttaaagacataaagcttgtcctggtaaacatggtctaaatgagaaatgcctccatcttttcaggtagaaccagatttcaggcatagctcagctacatctgtatttgaaatacaataaaaatatttcttatgtctctgtattctcttttaaaaagaactgctgactggctcctgtctcttcagtaacactgatttttttttaaagaagtgatatgttggactctgttgtagaagaatgagcactagtattcagcaacaagtgcaatttctccatgttatgttgagctctgttggagcctatggtgagtatttgatgtgaaaaccttgctgtgggaattttttattcttccttttccccccacgccagttcgttttggtaagtcttttatttgaacacaagacgcatgcttttttaaacctctagtttttgaagtaactgtagaagagaatctttaaaaaaaaaaatggagggcagaatgcttgttagcaatctgaaaatcaaagctgaacaagctgcttaaagtttctgattaagaagtttaaaaagaaaaattaattgctactgctttccaggtaattgtattattagtttctgtataaaagaaacattattgctgttgtataaataaaattttcctgtggtacaa

SEQ ID NO: 152810 - DNA, 3848 bp, Homo sapiens
  Payload ID: 10055
  Gene Symbol: MPP6
  Gene Name: membrane protein, palmitoylated 6 (MAGUK p55 subfamily member 6)
  Uniprot ID: Q9NZW5
  ENST ID: ENST00000396475
  CDS Start-End: 300-1922
caactacgagccacgagtttgcagatggggctgctcggcggcgcctgtggctgagggagagcagcggcggcggggagcgaccgggagcggcggcagcggcggcgcggaggcggctgaggtgcgagccggactaaatcattttgctactttaaaaaaatcacgaaagtacattatttgaagtttggagaagaaagggatttggtaacaaaggacagccatttccattttaagcagctaaacagcaggagagatttctgtaagaaggtaccagctcagattccattgttcatcattttgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaagcattttgtatatgttttgatttagtacccttgcctttttcatcaaaggaattttcaaatcattcactctaacattggtctcatattttcactgtgataatgaatattacttgaaatagttttgtaaagctgtcatttagttcagtattcaaatagtgaagggttagtcttaatagaagaaaatatagttattgaccttccttcttataaatttcttacaaaagcagaattttaagtcagtgttatagctagtctactaccatctaaatctgacatcaaaagtctgatcagtttacgtattttcattatttcggagatgtatggctatccattctaatttatacagctatattagttttgtctcttcatttctatctttactgaaaaattgaagagcaataccttgcactctcttttgaggttattctttttatttgttgcagtgatatgatgctaactaatttaacatgtacacagtaagctctggggctggaagcaaggtcatgcagactgagagagtgccttatcctgtaaaaccttacagcaaaatgacacttgaagaaagtttattttcacatgtaaaattttgactgacaaaaggaacctactactttaaacaatggttttattagaacatggtcagcaaatgtatcatgcctctgcaaattttagtgatgtttagagatgcctctaagtttgcagttggaggtttttgtgcttttagaaatgtgatgtgatccttagggtacctgttttgtctgttgtgttgagaaccaaacccattgaacaacttaaaaaattgggaaataattgtcagctattttgtatacatacacacaaaatatatacattatataatatgtatattatgtattatataatatatataaaatgttttgtatattttttacatatctgttaaaaaatgtactttgtttttttgtttgtttgttttgagatggagtctctctctgtcacccatgctggagtacagtggcgcgatctcagcccgctgcaacctctgcctcctgggttcatgcgactctcgtgcctcagcctcccaagtaattgagattacagttgggtgccaccatgtccggctaatttttgtatttttagtacagatggggtttcaccatgttggccagggtggtctcgagctcctgacctcaagtgatccacccaccttggcctcccaaagtgctgagattacaagcatgagccactgcacctagccaagaagtgtactttttgtttaatgattaccgaaagaagttctcctttagaagcattgacttatacaaattcccacattcacctcagttaatatcttcctttaggattcttggataatagaaattcttcctaaaacatactcagagatgcagctcattattaaattaaggtaaccacattctgtattgttgctagcttttcatgtaaacattattcacactttaaaggattaggtgtttaaatattgatggtcatctttgtctggtgttaggtgccagacacctggctgctgaatttgttttttccctcaccaaagttgtcatttggaacgccagctgggaggactttgaaggaaaagaaaatatatgacaataggcagtattgacacattgtttaaaatctttttcacaataaaacaaaacacccaa

SEQ ID NO: 152811 - DNA, 1703 bp, Homo sapiens
  Payload ID: 10055
  Gene Symbol: MPP6
  Gene Name: membrane protein, palmitoylated 6 (MAGUK p55 subfamily member 6)
  ENST ID: ENST00000409761
  CDS Start-End: 399-1685
gggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaac

SEQ ID NO: 152812 - DNA, 1191 bp, Homo sapiens
  Payload ID: 10055
  Gene Symbol: MPP6
  Gene Name: membrane protein, palmitoylated 6 (MAGUK p55 subfamily member 6)
  ENST ID: ENST00000430180
  CDS Start-End: 269-1191
gggagtcgcggtggagcctgaatggagagccggcctgggggcggcgttgctgtgactgacacctccggggtctgtcccgagagggggtgattccgccggctcccggttctctcccgagctcggagttggtaggggaggaggctttctccaactaccgccgctacttccgaggtacgagactccagttgtttggccaaagtggctgtgggccgagcacaggctgccgcgggggcgttcgctgctgagatcgtgctcgcggattctcgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagagattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaa

SEQ ID NO: 152813 - DNA, 982 bp, Homo sapiens
  Payload ID: 10055
  Gene Symbol: MPP6
  Gene Name: membrane protein, palmitoylated 6 (MAGUK p55 subfamily member 6)
  ENST ID: ENST00000432190
  CDS Start-End: 332-982
cgcgcccaagcggcggcggcggcggcggctggaggaggaggaggaggaggaggaggaggaggagggcggctgaggcgcggctggctgcgcgcgcggaggcagcggcgggggcgaccggagctggggcagagtggggagcgagggagggggaggagagagagggaggcggagggcagtgagagacgcatttccagttctcaactacgagccacgagtttgcagatggggctgctcggcggcgcctgtggctgagggagagcagcggcggcggggagcgaccgggagcggcggcagcggcggcgcggaggcggctgaggtgcgagccgcagcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacag

SEQ ID NO: 152814 - DNA, 552 bp, Homo sapiens
  Payload ID: 10055
  Gene Symbol: MPP6
  Gene Name: membrane protein, palmitoylated 6 (MAGUK p55 subfamily member 6)
  ENST ID: ENST00000426450
  CDS Start-End: 244-369
caaaatggtaaattaaaggcaccatctttgggactccctggggaaaaacgtaaagaaggcagttgaagaaaggactaaatcattttgctactttaaaaaaatcacgaaagtacattatttgaagtttggagaagaaagggatttggtaacaaaggacagccatttccattttaagcagctaaacagcaggagagatttctgtaagaaggtaccagctcagattccattgttcatcattttgcaatgcagcaagtcttggaaaaccttacggagctgccctcgtctactggagcagaagaaatagacctaattttcctcaagggaattatggagaatcctattgtaaaatcacttgctaagggcctgtgaaaaagatcctgatcctatttccattttcaacaatggcaaagtactgattttcttcttttgcattagactgtgtacctacttttcatgctcatgagaggctagaagattccaaactagaagctgtcagtgacaataacttggaattagtcaatgaaattcttgaagacatcactcctctaataa

SEQ ID NO: 152815 - DNA, 1125 bp, Homo sapiens
  Payload ID: 10055
  Gene Symbol: MPP6
  Gene Name: membrane protein, palmitoylated 6 (MAGUK p55 subfamily member 6)
  ENST ID: ENST00000464384
  CDS Start-End: 1-193
ttcaggacctttttgtggaactataagtagcaaaaaaaagaaaaagatgatgtatctcacaaccagaaatgcagttgcagaggatgacagaaataaaaaacagctctatgaatcagaaatttctggaggcttaatcaaaggagttggcaattttaaaagtactttcttgacttcagagctacctctatgctgaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaa

SEQ ID NO: 152816 - DNA, 126 bp, Homo sapiens
  Payload ID: 10055
  Gene Symbol: MPP6
  Gene Name: membrane protein, palmitoylated 6 (MAGUK p55 subfamily member 6)
  ENST ID: ENST00000625307
  CDS Start-End: 1-126
atgcagcaagtcttggaaaaccttacggagctgccctcgtctactggagcagaagaaatagacctaattttcctcaagggaattatggagaatcctattgtaaaatcacttgctaagggcctgtga

SEQ ID NO: 152817 - DNA, 5080 bp, Homo sapiens
  Payload ID: 10056
  Gene Symbol: MPP7
  Gene Name: membrane protein, palmitoylated 7 (MAGUK p55 subfamily member 7)
  Uniprot ID: Q5T2T1
  ENST ID: ENST00000337532
  CDS Start-End: 278-2008
aggtatagcagtcttggcagttgctgaactgaattcctggctgatttccttactgcataaactcaactgctctcactgaggtcgtcattaagtcctgtgtgtgtttgggcaggccgacttgatttacagccagcactccactgcggaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggcattcaatgagctcaaaacaacttttgacaaattagagacagagacccattgggtgccagtgagctggttacattcataactaagagaaatttccataattgtctttttctatagagtgcatgatgaaatcaattacagttttggtagtagggtttttaaatctatatcactgtcatagatgtacaatcttggttcaagttgaatgctggttttgtttgtatctttttacagccttatttcaaacgccatgtgttagtataagatccgaaatcaaaatatgcacagtactgtattctaagcaaaacctcaaaccttctcgttgtcttcaataccgctctatctccaagatgaggctgaaattttcagagagacttagctagaggcttagtatgtatgggagttcagcgcttctgctggtctcaggtgtggctgctgctgtcgagtttgaatgttagctgttgaaggtatcaattcagcagccatgagcagctccagacagacaggtgagctctgctgtttctgggtggatcatcacagatttagccgggcaggcagtaaggtgtcctcttactattcaaaaagtgtagactttcttacatattcgcaatacgttcacagtgtgtgcattttaaaataattcttaaaggagtaactgaaattttaccttgagtgaatggccttcataatatagcttgagaagtccttttgagtacctgtcagtgactcaacaacatttaataagggaaagtagacttttaacagttattatatatgtaacgaaaagcctttcctttgggattaatataagtaagaatggtagccttgtggcaagaaatgattacaaaggatatttttatttgtaattcctcagaagacaatttatgaagtcacccaaaatgttattttagctggttttggatttttccaataaattagaagaaggatttctattctaaaacatgtaaaacctgttttacatattactgatacaattaaagattatttttcatctatgtgcaatagatcacccctctttaaattgctctaagatttattttagaaaacttttcatgtgatgttatttctttgtcatcaaaatgcttgttaacactgtccagacaccatcctaaccttgccattgttaaagaagtttaggaaagactcttatattgtaaatatttagatgggttctctcacttttctttgatactactgattttcagcaagtgaattatataattcaaaatgctagaaatgtctatccgttctataagagagcatatcctgccgttcttgcatgcagtgaagccctgcccgtcgaaaatcattgcatctgtgactttcaaagtggaaaaaaaaatgttatttttttgttgatttgtaaagagagtttaaatgtcatgtgaaaaaaaatagaatgtagtaaaattctatatatttatgaaatattttaaaggcatatttttttaaatatcaaacggggctattcataaaataaactgattgtatgtcaagatgtcctaatttaaaagagtagttttataaatcatggtcaacattccatgtaaatatttgagctttacaaagatagatccaagtgtgcgatctgtgcactgcacatttgatagcattattcactggttttccttcatacttgtcaagttcatattagaagcagagacaaaaaccactccaatggccttgacacatagtcacaccaaaatagataatcagactaagtattatataacaacgtgatccagacagtgagttctaagtgtattaattaaatagcaaaaaattttgtttttaaaaaatgaaagagggagggttgccaacctgaagtcttaagtagattgtttgggtagcatatttccttctttgaacattgtctgaaattttctataaatcaagacttcttgtacaaagaatgatgggacatatgtaataattcaggcaatcacctgagtaatttaggcagtccaaattctttaccctgaaatacccacattttaaaaaaattgcagataattgcttcagttatttactttggggacagagatatagtgtaaagtgggagaaactgagtccttttttggtggtggtaataataagatgttataaaaatataacattttaaaaaagaaaggtccagaccttaagcgcagagctagaacaatattttttaaataatggggggaaaagggggcactttggtaattttagaaatcaggtagtatacttttttttttttttttgagacagggtcttgccatgttgctcaggctggtcttgaactcctgggctcaagcaatcctcctgccttggcctcccaaagtgctgggattacaggcatgatccaccgtgcccagccggtagacgtggtcttaaaaacagtgtttacatggccatcttgatgcttagaaagataattgattaaaatttaataaggcagggccaactccgagagttcattgacaacggcagcaaaaaggccctgaattctgtactttcttcccccagcctccttctccagcaaggagaatagcactcctccctccagaagccagctccctaagttggagccactatgtaagagaagaggaacgttcactttttaaaattcatatatttaaaaatcaagaccaaaaagtaaattctgtactcctattattgactgtagtcaatcaaacataaaaaggtgaaagtaaaatttaattttttacccttattttactgaccaatatggaagttcttggtatctttaaggctgaccttcctggtattgtgtaatgattgaatgtatctaaactgtaataatttgaaactgacaaacataaccttctcagacttacaaaactatgttctttctaaagatacagatttttattattttattttgactaggaaggatttataaataaatgtaatgaaaaatctttgatcttaataaagtaccttcaaacagtgtgtgtacttacttgaaaattgtttttgcacttggatattctattttattatactactattgtgatctattccattatactatttcccatggtagaacaaattatattttctactgtgatatgaagtgatgtaattgaacttgccatgtctaaaattaaatttcatatttttttcaatcaaa

SEQ ID NO: 152818 - DNA, 2090 bp, Homo sapiens
  Payload ID: 10056
  Gene Symbol: MPP7
  Gene Name: membrane protein, palmitoylated 7 (MAGUK p55 subfamily member 7)
  Uniprot ID: Q5T2T1
  ENST ID: ENST00000375719
  CDS Start-End: 356-2086
ataaacagcaggttctcctaggctttgaacaaaatttagcttctccaaggccaaaagcctcattgtgaagagaaagaaaggtatagcagtcttggcagttgctgaactgaattcctggctgatttccttactgcataaactcaactgctctcactgaggtcgtcattaagtcctgtgtgtgtttgggcaggccgacttgatttacagccagcactccactgcggaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggcattcaatgagctcaaaacaacttttgacaaattagagacagagacccattgggtgccagtgagctggttacattcataactaa

SEQ ID NO: 152819 - DNA, 5063 bp, Homo sapiens
  Payload ID: 10056
  Gene Symbol: MPP7
  Gene Name: membrane protein, palmitoylated 7 (MAGUK p55 subfamily member 7)
  Uniprot ID: Q5T2T1
  ENST ID: ENST00000375732
  CDS Start-End: 261-1991
aatggaactaacaggaaccacctgtgcacttccttttacaggaatgttcataaacagcaggttctcctaggctttgaacaaaatttagcttctccaaggccaaaagcctcattgtgaagagaaagaaagaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggcattcaatgagctcaaaacaacttttgacaaattagagacagagacccattgggtgccagtgagctggttacattcataactaagagaaatttccataattgtctttttctatagagtgcatgatgaaatcaattacagttttggtagtagggtttttaaatctatatcactgtcatagatgtacaatcttggttcaagttgaatgctggttttgtttgtatctttttacagccttatttcaaacgccatgtgttagtataagatccgaaatcaaaatatgcacagtactgtattctaagcaaaacctcaaaccttctcgttgtcttcaataccgctctatctccaagatgaggctgaaattttcagagagacttagctagaggcttagtatgtatgggagttcagcgcttctgctggtctcaggtgtggctgctgctgtcgagtttgaatgttagctgttgaaggtatcaattcagcagccatgagcagctccagacagacaggtgagctctgctgtttctgggtggatcatcacagatttagccgggcaggcagtaaggtgtcctcttactattcaaaaagtgtagactttcttacatattcgcaatacgttcacagtgtgtgcattttaaaataattcttaaaggagtaactgaaattttaccttgagtgaatggccttcataatatagcttgagaagtccttttgagtacctgtcagtgactcaacaacatttaataagggaaagtagacttttaacagttattatatatgtaacgaaaagcctttcctttgggattaatataagtaagaatggtagccttgtggcaagaaatgattacaaaggatatttttatttgtaattcctcagaagacaatttatgaagtcacccaaaatgttattttagctggttttggatttttccaataaattagaagaaggatttctattctaaaacatgtaaaacctgttttacatattactgatacaattaaagattatttttcatctatgtgcaatagatcacccctctttaaattgctctaagatttattttagaaaacttttcatgtgatgttatttctttgtcatcaaaatgcttgttaacactgtccagacaccatcctaaccttgccattgttaaagaagtttaggaaagactcttatattgtaaatatttagatgggttctctcacttttctttgatactactgattttcagcaagtgaattatataattcaaaatgctagaaatgtctatccgttctataagagagcatatcctgccgttcttgcatgcagtgaagccctgcccgtcgaaaatcattgcatctgtgactttcaaagtggaaaaaaaaatgttatttttttgttgatttgtaaagagagtttaaatgtcatgtgaaaaaaaatagaatgtagtaaaattctatatatttatgaaatattttaaaggcatatttttttaaatatcaaacggggctattcataaaataaactgattgtatgtcaagatgtcctaatttaaaagagtagttttataaatcatggtcaacattccatgtaaatatttgagctttacaaagatagatccaagtgtgcgatctgtgcactgcacatttgatagcattattcactggttttccttcatacttgtcaagttcatattagaagcagagacaaaaaccactccaatggccttgacacatagtcacaccaaaatagataatcagactaagtattatataacaacgtgatccagacagtgagttctaagtgtattaattaaatagcaaaaaattttgtttttaaaaaatgaaagagggagggttgccaacctgaagtcttaagtagattgtttgggtagcatatttccttctttgaacattgtctgaaattttctataaatcaagacttcttgtacaaagaatgatgggacatatgtaataattcaggcaatcacctgagtaatttaggcagtccaaattctttaccctgaaatacccacattttaaaaaaattgcagataattgcttcagttatttactttggggacagagatatagtgtaaagtgggagaaactgagtccttttttggtggtggtaataataagatgttataaaaatataacattttaaaaaagaaaggtccagaccttaagcgcagagctagaacaatattttttaaataatggggggaaaagggggcactttggtaattttagaaatcaggtagtatacttttttttttttttttgagacagggtcttgccatgttgctcaggctggtcttgaactcctgggctcaagcaatcctcctgccttggcctcccaaagtgctgggattacaggcatgatccaccgtgcccagccggtagacgtggtcttaaaaacagtgtttacatggccatcttgatgcttagaaagataattgattaaaatttaataaggcagggccaactccgagagttcattgacaacggcagcaaaaaggccctgaattctgtactttcttcccccagcctccttctccagcaaggagaatagcactcctccctccagaagccagctccctaagttggagccactatgtaagagaagaggaacgttcactttttaaaattcatatatttaaaaatcaagaccaaaaagtaaattctgtactcctattattgactgtagtcaatcaaacataaaaaggtgaaagtaaaatttaattttttacccttattttactgaccaatatggaagttcttggtatctttaaggctgaccttcctggtattgtgtaatgattgaatgtatctaaactgtaataatttgaaactgacaaacataaccttctcagacttacaaaactatgttctttctaaagatacagatttttattattttattttgactaggaaggatttataaataaatgtaatgaaaaatctttgatcttaataaagtaccttcaaacagtgtgtgtacttacttgaaaattgtttttgcacttggatattctattttattatactactattgtgatctattccattatactatttcccatggtagaacaaattatattttctactgtgatatgaagtgatgtaattgaacttgccatgtctaaaattaaatttcatatttttttcaatcaaa

SEQ ID NO: 152820 - DNA, 1210 bp, Homo sapiens
  Payload ID: 10056
  Gene Symbol: MPP7
  Gene Name: membrane protein, palmitoylated 7 (MAGUK p55 subfamily member 7)
  ENST ID: ENST00000441595
  CDS Start-End: 275-1210
gcaaaacagtagcttcactcagacaccgtaaccatcatctcatcctggatgcaattgctgtggttaacacaggaagaaaaggagaagtatcactctttttgctgcacaaatgtgaaaactcacaataaagagaagggagaaagaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggca

SEQ ID NO: 152821 - DNA, 4895 bp, Homo sapiens
  Payload ID: 10056
  Gene Symbol: MPP7
  Gene Name: membrane protein, palmitoylated 7 (MAGUK p55 subfamily member 7)
  ENST ID: ENST00000496637
  CDS Start-End: 134-1498
agaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagagtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaaaaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtatgtggacatttttgagaattttcatgtgactgttttttataagcacatgcctgtcccgttttagacaactgagagttctccatttgaagtgtattttaattatcataataatatttgaaacagatgaaaaggtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaagtcaatatggtcatctttttgacaaaattataataaatgatgacctcactgtggcattcaatgagctcaaaacaacttttgacaaattagagacagagacccattgggtgccagtgagctggttacattcataactaagagaaatttccataattgtctttttctatagagtgcatgatgaaatcaattacagttttggtagtagggtttttaaatctatatcactgtcatagatgtacaatcttggttcaagttgaatgctggttttgtttgtatctttttacagccttatttcaaacgccatgtgttagtataagatccgaaatcaaaatatgcacagtactgtattctaagcaaaacctcaaaccttctcgttgtcttcaataccgctctatctccaagatgaggctgaaattttcagagagacttagctagaggcttagtatgtatgggagttcagcgcttctgctggtctcaggtgtggctgctgctgtcgagtttgaatgttagctgttgaaggtatcaattcagcagccatgagcagctccagacagacaggtgagctctgctgtttctgggtggatcatcacagatttagccgggcaggcagtaaggtgtcctcttactattcaaaaagtgtagactttcttacatattcgcaatacgttcacagtgtgtgcattttaaaataattcttaaaggagtaactgaaattttaccttgagtgaatggccttcataatatagcttgagaagtccttttgagtacctgtcagtgactcaacaacatttaataagggaaagtagacttttaacagttattatatatgtaacgaaaagcctttcctttgggattaatataagtaagaatggtagccttgtggcaagaaatgattacaaaggatatttttatttgtaattcctcagaagacaatttatgaagtcacccaaaatgttattttagctggttttggatttttccaataaattagaagaaggatttctattctaaaacatgtaaaacctgttttacatattactgatacaattaaagattatttttcatctatgtgcaatagatcacccctctttaaattgctctaagatttattttagaaaacttttcatgtgatgttatttctttgtcatcaaaatgcttgttaacactgtccagacaccatcctaaccttgccattgttaaagaagtttaggaaagactcttatattgtaaatatttagatgggttctctcacttttctttgatactactgattttcagcaagtgaattatataattcaaaatgctagaaatgtctatccgttctataagagagcatatcctgccgttcttgcatgcagtgaagccctgcccgtcgaaaatcattgcatctgtgactttcaaagtggaaaaaaaaatgttatttttttgttgatttgtaaagagagtttaaatgtcatgtgaaaaaaaatagaatgtagtaaaattctatatatttatgaaatattttaaaggcatatttttttaaatatcaaacggggctattcataaaataaactgattgtatgtcaagatgtcctaatttaaaagagtagttttataaatcatggtcaacattccatgtaaatatttgagctttacaaagatagatccaagtgtgcgatctgtgcactgcacatttgatagcattattcactggttttccttcatacttgtcaagttcatattagaagcagagacaaaaaccactccaatggccttgacacatagtcacaccaaaatagataatcagactaagtattatataacaacgtgatccagacagtgagttctaagtgtattaattaaatagcaaaaaattttgtttttaaaaaatgaaagagggagggttgccaacctgaagtcttaagtagattgtttgggtagcatatttccttctttgaacattgtctgaaattttctataaatcaagacttcttgtacaaagaatgatgggacatatgtaataattcaggcaatcacctgagtaatttaggcagtccaaattctttaccctgaaatacccacattttaaaaaaattgcagataattgcttcagttatttactttggggacagagatatagtgtaaagtgggagaaactgagtccttttttggtggtggtaataataagatgttataaaaatataacattttaaaaaagaaaggtccagaccttaagcgcagagctagaacaatattttttaaataatggggggaaaagggggcactttggtaattttagaaatcaggtagtatacttttttttttttttttgagacagggtcttgccatgttgctcaggctggtcttgaactcctgggctcaagcaatcctcctgccttggcctcccaaagtgctgggattacaggcatgatccaccgtgcccagccggtagacgtggtcttaaaaacagtgtttacatggccatcttgatgcttagaaagataattgattaaaatttaataaggcagggccaactccgagagttcattgacaacggcagcaaaaaggccctgaattctgtactttcttcccccagcctccttctccagcaaggagaatagcactcctccctccagaagccagctccctaagttggagccactatgtaagagaagaggaacgttcactttttaaaattcatatatttaaaaatcaagaccaaaaagtaaattctgtactcctattattgactgtagtcaatcaaacataaaaaggtgaaagtaaaatttaattttttacccttattttactgaccaatatggaagttcttggtatctttaaggctgaccttcctggtattgtgtaatgattgaatgtatctaaactgtaataatttgaaactgacaaacataaccttctcagacttacaaaactatgttctttctaaagatacagatttttattattttattttgactaggaaggatttataaataaatgtaatgaaaaatctttgatcttaataaagtaccttcaaacagtgtgtgta

SEQ ID NO: 152822 - DNA, 5367 bp, Homo sapiens
  Payload ID: 10057
  Gene Symbol: MARCH1
  Gene Name: membrane-associated ring finger (C3HC4) 1, E3 ubiquitin protein ligase
  Uniprot ID: Q8TCQ1
  ENST ID: ENST00000274056
  CDS Start-End: 48-917
tattttcagaatttcagaaattgaaaagggataagaggaaggagaaaatgctgggctggtgtgaagcgatagcccgtaaccctcacagaattccaaacaacacgcgaacacccgagatctcaggggatttggctgacgcctcacaaacctccacattgaatgaaaaatccccagggcgatctgcaagtcgatcaagtaacatttcaaaagcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcgatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattacgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatgcaaatatttaacttcccagtagccctattttaaaaagtaaaaataaatgtttgtttgttaaaatgaattttgattttttaaaaacactatatgttatttcaacatgtcatcaatataaaaaattgattgattgattgatagtttacatctgtttcttgaaccaagttttcaaaatccagttggtaatttaaaagtacacttcaacttgaattaactatattggatagcacagccgtaaaattagagactaagcttctgctttatttaacagttgttgagtatttcaaaacagtttaattcattcttttatttcaaagtcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatccatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgacttatttttgttagctgtcattatttattaacatgaaaaggcaatgatggccataagaaccaaagcatgagtatcacactgcacaaatctgggtatcacatggatgcactttgtaattatcagtgtgcttgttcttcacagatcataggaaaaagggaaaaaaaaaacaaacctttaaatgaggagaaagatggtataaatattagtagtggctgacactgagtccagatagtcttgattcctagaaataaacaaaaggtaaacaatgtcaattttgtgtgtgtgtatggcgtgtgtgtagtcatgtatatatgcggggaaaatgttaaggtattcagtcaggaaacaaaaggtttaaaactcatctttcttaaaacttgttataagcacagggaaagcaaagttgaggtaactaaactgaaccaaaaattctgtataaataaggatataagtaattaacgttttaaaaaacatgtggaccttaaacaaactgtatattaaattcctcttaaatgcccattttaaatatttaagataaatacatttatgaataacaaatctgtgggtgatttaaccatggcaccatatccaagggattaaccttaatgcaattttcctgttaattgtcctaagctttttactaatccattttccctgtgggttagtaatggcaacatgctgcttacagatattcccggggaaaaacatccagacaccagcaaacaaagaaatgttgatttctcttttgtttgctctgaaagtaaaataattatttactttaattaacatggaaaatattgtttaaattctgtacgaacctaaacaagatacgttgcagggctgatttcacagtggaggatgatcggctaaaataaagcctcatttattaagggctacacttttaacactaagaaaacatttctagaataaaaagcaaaggtaagcattattctattaatagtaaaagaggacatgggattttaaaactatacctaaattcttgcaattaacttttatgggcttggacattgttgaaatgagaaaataatataatatagcttcctggcaggttaaaagtcaacacttgattttgctattcttctgactttttgaaaccctgaagttctgaatttcaagcttttaagaagcttttcagcaatggttgtttgtttatggttcaaacatctgaaataactacctgcatttaaaatctaatgttgattattttctttttacattctgtgtggcaatggaacatttgccctttcaaacaataaaacgatttagctttgtggcagtgcttttttgtagactgactgactatacccttcaaaaagaaaaactgctctacggaatgcaaattttgaggcatgtttacctgctcgtggaagaaataaaatggaattgaaaaaaaaaggactaaaattgaagaatgaaattacagttgtgttaaaaaccttggctctttataatcatgaatcttcagtattaaaccagacattgatgctgttaatttttttaaagaactatcactcttatcgtacaggagtaaagattaaattgtaaaagaaagaaattccaattttttaaaaagtaaagcccaaaaggcaattaagcttaagtacaaaaacaaaataaaaatgaacaaaatctaaactaaagtgagcccaacaacctgagatacagcaatgtgtaacctgaaggaagataggtgtagactgaaggagtctttcaaaacaccccagcattaaatctcactctgcgctgcttctacacgtgattatagtcccagacagacgacctcatggttttttatcttgttttacaaaaggtccttgggtactctttaaaacatctattctttggcaggaaaattagctcattagaacaatgacaccattaagggacattataagggtcctggggctgaggtgggaagatttttctatctgccccatatagtttacccttccttgccttgaaaatgaatattatagaacagagtacagctcttaaaagttattagtatcattattattatagttgttatataatactttaattaagaaagatgaaaaccttttttctttcctaagtcagcccaatggtgctattttacatatcaacacagttgaaaggaagtactgttattttgggctgcagtgtttcctccacatctaaagaaagcccattttgaaactggatactgcattaaaacaaagaaggaaaaattattttaactgtgtgcagtttttgaaattaggcatttgtactattttggttttacataattctcttgcattaacaatttactgttttgtgaatcatgtgtactaaagcaaattaagaaaaagaaaataattatctgtgaaagactttgtatattaaacaagtgacgcaaaccttagttgtggtttccacaatttttgcctaacagactgatatttgtatttgcaacatccaaacacacatacattttttaagattttacaagggtctgaacatataattattttaaagcaaacctacgttgactaactcatgacatggtacaaataaataaatacacaaacagagggaaaccaatgaaaataaactatgtggactttcaaacctgctttaaaaaaagagttcaagagaaatcacaatgtaatctaaagcgggactgtctcaagaataagtcttggatatagaaaaataagcatataacagcatttttctgttcagagataatagtggattcagataattgcatggataataaacattaaaagcaagatattagaatctaagaggtttggtgatagcaaaaaacaaagctgtttcc

SEQ ID NO: 152823 - DNA, 2476 bp, Homo sapiens
  Payload ID: 10057
  Gene Symbol: MARCH1
  Gene Name: membrane-associated ring finger (C3HC4) 1, E3 ubiquitin protein ligase
  Uniprot ID: Q8TCQ1
  ENST ID: ENST00000339875
  CDS Start-End: 31-849
ctatattctctgttctgcattataagcaacatgaccagcagccacgtttgttgtaattttttaaatatgtggaaaaaaagcaagatatcaaccatgtattaccttaaccaagatgccaaattatctaacttgtttctccaggcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcgatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattacgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatgcaaatatttaacttcccagtagccctattttaaaaagtaaaaataaatgtttgtttgttaaaatgaattttgattttttaaaaacactatatgttatttcaacatgtcatcaatataaaaaattgattgattgattgatagtttacatctgtttcttgaaccaagttttcaaaatccagttggtaatttaaaagtacacttcaacttgaattaactatattggatagcacagccgtaaaattagagactaagcttctgctttatttaacagttgttgagtatttcaaaacagtttaattcattcttttatttcaaagtcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatccatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgactta

SEQ ID NO: 152824 - DNA, 3903 bp, Homo sapiens
  Payload ID: 10057
  Gene Symbol: MARCH1
  Gene Name: membrane-associated ring finger (C3HC4) 1, E3 ubiquitin protein ligase
  ENST ID: ENST00000514618
  CDS Start-End: 489-2126
actggggagccgagccagagccgggctgcctgccacccggctgctcgtccgctagctggggaggagcgctccacccgcaactgacaaaggatgggagaatgcccgcgccccgggatgccggccgcacgcagcctggcggccgcctgagctacttcaccctccgccggaaatgtaccccaaaagaactctgagagaatatactcaactgtcctgctgtgattaaacaagactgctgtattttacctgagcttggcaaagcaaggatatgaacaattgtgcaggtgggctactcagggcgagtgaagagataaggcatccaatcagggattggccacctgcagccctgccaatatgcccctccaccagatttccgtaatcccagcacgggagactgccagcaatgggagaaattcaatgggcagaaacaaagagaagaacaaggaagtcgagaatttcagaaattgaaaagggataagaggaaggagaaaatgctgggctggtgtgaagcgatagcccgtaaccctcacagaattccaaacaacacgcgaacacccgagatctcaggggatttggctgacgcctcacaaacctccacattgaatgaaaaatccccagggcgatctgcaagtcgatcaagtaacatttcaaaagcaagcagcccaacaacagggacagctcccaggagccagtcaaggttgtctgtctgtccatccactcaggacatctgcagatctgccatcttgcatgacatgtcagaagagtcatttgagtattgcacccctgtcatggtgctgagccctgctaggaaggagtctggtaagaaatcagtaatacaaagacctaggaggaggagaaaagcctctgagagatatgagcatgctgcagaagaacaaataagagggagaaaaaatgactttcaccttcaaatctcaagccccaggtggagggagctttacacagattcttcagattcatcttccacagatgagagtcattggattcaggcaaaaagaagagcccaggttaaattcagactgtcaagaagaaggaggagaaataataataagccgtgtgaaaacttagctgggtcttccactcctaacggaattgagctcgttgatctgggatccaaaggtaaagagcaacaagagctgattgaatgtgagagttgctctttaaatctccacagaggaaaacatacaaggtaccaagaatgcaacccttctctgactcaagggtcctctgaaattaagagatcctcaaggaatcatgagaagagcaaaggcagatatcaccacagagatcctcagctcttgcaaagtcttaggaaaaatgaaataatgaagaagacattttcagaaacagattccagcactgaaatactgggagttccagaaggcagcaaggacatgaatgatgcagggctccaggtgaataaccctgttcagaagcctcctgccacctatgacgatgggtctgataatttagaagtatgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcgatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattacgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatgcaaatatttaacttcccagtagccctattttaaaaagtaaaaataaatgtttgtttgttaaaatgaattttgattttttaaaaacactatatgttatttcaacatgtcatcaatataaaaaattgattgattgattgatagtttacatctgtttcttgaaccaagttttcaaaatccagttggtaatttaaaagtacacttcaacttgaattaactatattggatagcacagccgtaaaattagagactaagcttctgctttatttaacagttgttgagtatttcaaaacagtttaattcattcttttatttcaaagtcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatccatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgacttatttttgttagctgtcattatttattaacatgaaaaggcaatgatggccataagaaccaaagcatgagtatcacactgcacaaatctgggtatcacatggatgcactttgtaattatcagtgtgcttgttcttcacagatcataggaaaaa

SEQ ID NO: 152825 - DNA, 1051 bp, Homo sapiens
  Payload ID: 10057
  Gene Symbol: MARCH1
  Gene Name: membrane-associated ring finger (C3HC4) 1, E3 ubiquitin protein ligase
  ENST ID: ENST00000510786
  CDS Start-End: 10-444
ataagcaacatgaccagcagccacgtttgttgtaattttttaaatatgtggaaaaaaagcaagatatcaaccatgtattaccttaaccaagatgccaaattatctaacttgtttctccaggcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgtctgtgcttctgcttagtacacgagcactgtctcctaaacggcaaggctatgatcacttaggcacagagagtgaccacagacctgtgcagattccacgtgtgccatagctgttcactgaagagtgggagaaactacagatgaccacaagtgaaaggaggaaaatattctgctctgtcacattccacgtaatcgcgatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagct

SEQ ID NO: 152826 - DNA, 656 bp, Homo sapiens
  Payload ID: 10057
  Gene Symbol: MARCH1
  Gene Name: membrane-associated ring finger (C3HC4) 1, E3 ubiquitin protein ligase
  ENST ID: ENST00000507270
  CDS Start-End: 234-656
gtccgctagctggggaggagcgctccacccgcaactgacaaaggatgggagaatgcccgcgccccgggatgccggccgcacgcagcctggcggccgcctgagctacttcaccctccgccggaaatgtaccccaaaagaactctgagagaatatactcaactgtcctgctgtgattaaacaagactgctgtattttaatttcagaaattgaaaagggataagaggaaggagaaaatgctgggctggtgtgaagcgatagcccgtaaccctcacagaattccaaacaacacgcgaacacccgagatctcaggggatttggctgacgcctcacaaacctccacattgaatgaaaaatccccagggcgatctgcaagtcgatcaagtaacatttcaaaagcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaag

SEQ ID NO: 152827 - DNA, 5877 bp, Homo sapiens
  Payload ID: 10057
  Gene Symbol: MARCH1
  Gene Name: membrane-associated ring finger (C3HC4) 1, E3 ubiquitin protein ligase
  Uniprot ID: Q8TCQ1
  ENST ID: ENST00000503008
  CDS Start-End: 978-1847
agaggaggggagaggactggggagccgagccagagccgggctgcctgccacccggctgctcgtccgctagctggggaggagcgctccacccgcaactgacaaaggatgggagaatgcccgcgccccgggatgccggccgcacgcagcctggcggccgcctgagctacttcaccctccgccggtaagtgactgcaaacatcattcattcaatcagcctcactgggagccccttctctccggctggtagtcctgggcggcttgtccctgatcccgagcggggcttggcacagcatcagccctggagggcaggcagcaggtgcctttgcctggtgggtccactggggagcgtggctggggttcgcggcgggtgctgccacccaacctgcgggcggcgggctcgcccagtaggcgcctctctggtgagaggaggcggctccagcccgcagcctggggtagttgctactattggcccccagcgcccgctctgcgcgcgcgccgtttctggcggatccccagtgcgcggcgcgctgtttacaccggcgtggtactagtcacggagccgcacccctcggaaagcgcggagtcgatgacagccacttcacaggctcacgcgctcctagtgtgggcttgaaggggacggggaccgattaccaaaggagagcgctgagtacggaagacacagggcagcctttgtcttgggtttagcgctgatgcgctcaaccctgagtcgggttcactgcaactgttgtgtccgatttcggttccctgcaaccgccctcctgggcgagagatgtcattgtgttcctgcggccagcgggactgagagctgggacttaagacgccaggagggtcctgcgctcacgggaaatgtaccccaaaagaactctgagagaatatactcaactgtcctgctgtgattaaacaagactgctgtattttaatttcagaaattgaaaagggataagaggaaggagaaaatgctgggctggtgtgaagcgatagcccgtaaccctcacagaattccaaacaacacgcgaacacccgagatctcaggggatttggctgacgcctcacaaacctccacattgaatgaaaaatccccagggcgatctgcaagtcgatcaagtaacatttcaaaagcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcgatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattacgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatgcaaatatttaacttcccagtagccctattttaaaaagtaaaaataaatgtttgtttgttaaaatgaattttgattttttaaaaacactatatgttatttcaacatgtcatcaatataaaaaattgattgattgattgatagtttacatctgtttcttgaaccaagttttcaaaatccagttggtaatttaaaagtacacttcaacttgaattaactatattggatagcacagccgtaaaattagagactaagcttctgctttatttaacagttgttgagtatttcaaaacagtttaattcattcttttatttcaaagtcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatccatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgacttatttttgttagctgtcattatttattaacatgaaaaggcaatgatggccataagaaccaaagcatgagtatcacactgcacaaatctgggtatcacatggatgcactttgtaattatcagtgtgcttgttcttcacagatcataggaaaaagggaaaaaaaaaacaaacctttaaatgaggagaaagatggtataaatattagtagtggctgacactgagtccagatagtcttgattcctagaaataaacaaaaggtaaacaatgtcaattttgtgtgtgtgtatggcgtgtgtgtagtcatgtatatatgcggggaaaatgttaaggtattcagtcaggaaacaaaaggtttaaaactcatctttcttaaaacttgttataagcacagggaaagcaaagttgaggtaactaaactgaaccaaaaattctgtataaataaggatataagtaattaacgttttaaaaaacatgtggaccttaaacaaactgtatattaaattcctcttaaatgcccattttaaatatttaagataaatacatttatgaataacaaatctgtgggtgatttaaccatggcaccatatccaagggattaaccttaatgcaattttcctgttaattgtcctaagctttttactaatccattttccctgtgggttagtaatggcaacatgctgcttacagatattcccggggaaaaacatccagacaccagcaaacaaagaaatgttgatttctcttttgtttgctctgaaagtaaaataattatttactttaattaacatggaaaatattgtttaaattctgtacgaacctaaacaagatacgttgcagggctgatttcacagtggaggatgatcggctaaaataaagcctcatttattaagggctacacttttaacactaagaaaacatttctagaataaaaagcaaaggtaagcattattctattaatagtaaaagaggacatgggattttaaaactatacctaaattcttgcaattaacttttatgggcttggacattgttgaaatgagaaaataatataatatagcttcctggcaggttaaaagtcaacacttgattttgctattcttctgactttttgaaaccctgaagttctgaatttcaagcttttaagaagcttttcagcaatggttgtttgtttatggttcaaacatctgaaataactacctgcatttaaaatctaatgttgattattttctttttacattctgtgtggcaatggaacatttgccctttcaaacaataaaacgatttagctttgtggcagtgcttttttgtagactgactgactatacccttcaaaaagaaaaactgctctacggaatgcaaattttgaggcatgtttacctgctcgtggaagaaataaaatggaattgaaaaaaaaaggactaaaattgaagaatgaaattacagttgtgttaaaaaccttggctctttataatcatgaatcttcagtattaaaccagacattgatgctgttaatttttttaaagaactatcactcttatcgtacaggagtaaagattaaattgtaaaagaaagaaattccaattttttaaaaagtaaagcccaaaaggcaattaagcttaagtacaaaaacaaaataaaaatgaacaaaatctaaactaaagtgagcccaacaacctgagatacagcaatgtgtaacctgaaggaagataggtgtagactgaaggagtctttcaaaacaccccagcattaaatctcactctgcgctgcttctacacgtgattatagtcccagacagacgacctcatggttttttatcttgttttacaaaaggtccttgggtactctttaaaacatctattctttggcaggaaaattagctcattagaacaatgacaccattaagggacattataagggtcctggggctgaggtgggaagatttttctatctgccccatatagtttacccttccttgccttgaaaatgaatattatagaacagagtacagctcttaaaagttattagtatcattattattatagttgttatataatactttaattaagaaagatgaaaaccttttttctttcctaagtcagcccaatggtgctattttacatatcaacacagttgaaaggaagtactgttattttgggctgcagtgtttcctccacatctaaagaaagcccattttgaaactggatactgcattaaaacaaagaaggaaaaattattttaactgtgtgcagtttttgaaattaggcatttgtactattttggttttacataattctcttgcattaacaatttactgttttgtgaatcatgtgtactaaagcaaattaagaaaaagaaaataattatctgtgaaagactttgtatattaaacaagtgacgcaaacctta

SEQ ID NO: 152828 - DNA, 3090 bp, Homo sapiens
  Payload ID: 10058
  Gene Symbol: MARCH10
  Gene Name: membrane-associated ring finger (C3HC4) 10, E3 ubiquitin protein ligase
  Uniprot ID: Q8NA82
  ENST ID: ENST00000311269
  CDS Start-End: 276-2702
gaaaccggaggacgcccggtagccgcccccaccgcctccgccccaggcaaggccggccggcgccgcggaaagcagcctcggggaaggaggaggaagaggggcaggtgtagggagtgaagaagcaaaaagaggaggaggaagaggagctcagggccgtccccgcgcaattaatgggcggctcctgcgccctggaccggcccgcccgcccagcccctcgacccctgtagccccggcaggggaggaagggcagacccacaggtcagggattaggaatcatgttgcatgacgcaagggacaggcagaagttcttcagcgatgttcagtatctgcgggacatgcagcataaggtggactctgagtatcaggcttgtctgagacgacaggaatatagaagagacccaaatgagaagaaacgcgatcagttttgggggcaagagacaagttttgagagatcccggttttctagcaggtcatcttccaaacagagttctagtgaggaggatgctctaactgaaccaaggtcatctatcaagatatctgcatttaagtgtgactccaaacttccagcaattgaccaaacatcagtcaagcagaaacataaaagtaccatgactgtaaggaaagcagagaaagtggaccccagcgaaccctctccagcagaccaagcaccaatggttttattaagaaagaggaagccaaacctgaggagatttacagtcagcccagaatcgcacagcccgagagcatctggggacagaagcagacagaaacagcagtggcctgcaaaggtgccggttcccaggggagcagatcaagtagttcaacaagaaggcctgatgtgtaacactaagctgaagaggccaaatcaagagagaagaaacttggtcccatcgtcacagccaatgactgagaacgcccctgatagagccaaaaaaggagacccgagtgctccttcccagagtgagctgcatccagccctgtcccaggccttccaaggaaaaaatagtcctcaagtattgagtgagttctcggggccaccactcacacccaccactgtaggagggccaagaaaggcatcatttaggttccgagatgaagacttttattccattttgtcattgaacagcagaagagaaagcgatgacactgaagaggaaacccagtctgaagaatgtctgtgggttggtgtgcgctcaccctgttctccttcccatcacaaaagaagtagatttggggggacatcgacccctcaggccaaaaataaaaattttgaagaaaatgctgaaaattgcagaggtcattcttcaagaagaagtgagcccagtcatggctcattgagaataagcaatgcaatggagccagcaacagagcggccttctgctgggcaaaggttgtcccaagaccccgggctgcctgatagggaatctgctacagagaaggacagaggtggcagtgaaaatgcgaaaaagagccctctttcgtgggacaccaaatccgagcccagacaagaggttggtgtcaatgctgaaaatgtatggagtgattgtatttctgtggaacataggcctggcacccatgattctgaaggatactggaaagactatttaaacagttctcaaaattctcttgactactttatttctggcagaccaatatctccaagatcatcagtgaattcatcctataaccctcctgcatcattcatgcattctgctctgagagatgatattccagtagacttgtcaatgtcatcgacttcagttcacagctcagactcagagggaaactcagggtttcatgtttgccaaccactgtctcccattagaaataggactccatttgccagtgccgaaaaccataattatttcccagtaaacagtgcacacgaatttgctgtcagggaagcagaagatactactttaacaagccagcctcagggggctccactatatacagatctcttactaaatccacagggcaatttgtccttagtggattcttccagctcctctccatcaagaatgaactcagaaggccatttgcatgtgtctgggtctctgcaagaaaatacaccatttactttctttgcagtgtctcatttcccaaatcaaaatgataatgggagcaggatggcagcctctggtttcacagatgaaaaggaaaccagtaagataaaggcagaccctgagaaactcaagaaattgcaagaaagtctcctggaggaggactccgaggaggagggagacttgtgtcgcatctgtcagatagccgggggttccccaagcaaccccctcctggagccttgcggctgtgtgggaagcctgcagtttgttcatcaagagtgcctgaaaaagtggctgaaagtgaaaataacatcaggagcagatcttggtgccgtgaagacctgtgagatgtgtaagcaaggcctgctggttgacctgggtgactttaacatgattgagttctaccagaagcaccagcaatctcaggcacaaaacgagctgatgaattcaggcttgtacctggtgctgctgcttcacctctatgagcagaggtttgcagaactcatgaggctcaaccacaaccaggtggaaagagagaggttgtcaagaaattacccacaacccagaacagaggaaaatgaaaattcggagttgggagatggaaatgaaggcagcatttctcaaagccaggtcgtctagcaaggaagccaactgtggagctcggcggagacctctcccgccagcccttctttctacgtccccaagtgcctccctccctcctcctctttactgaaactgaaaccaaagcgttcacagttagattttcacctcgtgccactctcttttggggtctggcttgagcatctatgggcagccacagcgaccagtctagtcccagacagcacaggtcaagcagcgtgggactgtggagcccctggcaggctggcctggtgctgcccccttagcccagaagccctgccaggtccagtggcctggggtcccactgctgagggcacctgccaggcctcactccaccctgaatggactcgagccatgtattcattcagtaaactgacattattctccc

SEQ ID NO: 152829 - DNA, 3057 bp, Homo sapiens
  Payload ID: 10058
  Gene Symbol: MARCH10
  Gene Name: membrane-associated ring finger (C3HC4) 10, E3 ubiquitin protein ligase
  Uniprot ID: Q8NA82
  ENST ID: ENST00000456609
  CDS Start-End: 242-2668
gaggccaagaagaattactcgctcttgctttcagcaaggcaggaccccctccttccttctccacctgcctccaactccctcctcctttctctctccctacttaatatggcttcttatgttgatttctaaagcacagatttggcacaagacattatcaccagaaagacttaaaacagaagtgtgcataaccatgagtgggttttaaattaagaagcagttcaaaggtcagggattaggaatcatgttgcatgacgcaagggacaggcagaagttcttcagcgatgttcagtatctgcgggacatgcagcataaggtggactctgagtatcaggcttgtctgagacgacaggaatatagaagagacccaaatgagaagaaacgcgatcagttttgggggcaagagacaagttttgagagatcccggttttctagcaggtcatcttccaaacagagttctagtgaggaggatgctctaactgaaccaaggtcatctatcaagatatctgcatttaagtgtgactccaaacttccagcaattgaccaaacatcagtcaagcagaaacataaaagtaccatgactgtaaggaaagcagagaaagtggaccccagcgaaccctctccagcagaccaagcaccaatggttttattaagaaagaggaagccaaacctgaggagatttacagtcagcccagaatcgcacagcccgagagcatctggggacagaagcagacagaaacagcagtggcctgcaaaggtgccggttcccaggggagcagatcaagtagttcaacaagaaggcctgatgtgtaacactaagctgaagaggccaaatcaagagagaagaaacttggtcccatcgtcacagccaatgactgagaacgcccctgatagagccaaaaaaggagacccgagtgctccttcccagagtgagctgcatccagccctgtcccaggccttccaaggaaaaaatagtcctcaagtattgagtgagttctcggggccaccactcacacccaccactgtaggagggccaagaaaggcatcatttaggttccgagatgaagacttttattccattttgtcattgaacagcagaagagaaagcgatgacactgaagaggaaacccagtctgaagaatgtctgtgggttggtgtgcgctcaccctgttctccttcccatcacaaaagaagtagatttggggggacatcgacccctcaggccaaaaataaaaattttgaagaaaatgctgaaaattgcagaggtcattcttcaagaagaagtgagcccagtcatggctcattgagaataagcaatgcaatggagccagcaacagagcggccttctgctgggcaaaggttgtcccaagaccccgggctgcctgatagggaatctgctacagagaaggacagaggtggcagtgaaaatgcgaaaaagagccctctttcgtgggacaccaaatccgagcccagacaagaggttggtgtcaatgctgaaaatgtatggagtgattgtatttctgtggaacataggcctggcacccatgattctgaaggatactggaaagactatttaaacagttctcaaaattctcttgactactttatttctggcagaccaatatctccaagatcatcagtgaattcatcctataaccctcctgcatcattcatgcattctgctctgagagatgatattccagtagacttgtcaatgtcatcgacttcagttcacagctcagactcagagggaaactcagggtttcatgtttgccaaccactgtctcccattagaaataggactccatttgccagtgccgaaaaccataattatttcccagtaaacagtgcacacgaatttgctgtcagggaagcagaagatactactttaacaagccagcctcagggggctccactatatacagatctcttactaaatccacagggcaatttgtccttagtggattcttccagctcctctccatcaagaatgaactcagaaggccatttgcatgtgtctgggtctctgcaagaaaatacaccatttactttctttgcagtgtctcatttcccaaatcaaaatgataatgggagcaggatggcagcctctggtttcacagatgaaaaggaaaccagtaagataaaggcagaccctgagaaactcaagaaattgcaagaaagtctcctggaggaggactccgaggaggagggagacttgtgtcgcatctgtcagatagccgggggttccccaagcaaccccctcctggagccttgcggctgtgtgggaagcctgcagtttgttcatcaagagtgcctgaaaaagtggctgaaagtgaaaataacatcaggagcagatcttggtgccgtgaagacctgtgagatgtgtaagcaaggcctgctggttgacctgggtgactttaacatgattgagttctaccagaagcaccagcaatctcaggcacaaaacgagctgatgaattcaggcttgtacctggtgctgctgcttcacctctatgagcagaggtttgcagaactcatgaggctcaaccacaaccaggtggaaagagagaggttgtcaagaaattacccacaacccagaacagaggaaaatgaaaattcggagttgggagatggaaatgaaggcagcatttctcaaagccaggtcgtctagcaaggaagccaactgtggagctcggcggagacctctcccgccagcccttctttctacgtccccaagtgcctccctccctcctcctctttactgaaactgaaaccaaagcgttcacagttagattttcacctcgtgccactctcttttggggtctggcttgagcatctatgggcagccacagcgaccagtctagtcccagacagcacaggtcaagcagcgtgggactgtggagcccctggcaggctggcctggtgctgcccccttagcccagaagccctgccaggtccagtggcctggggtcccactgctgagggcacctgccaggcctcactccaccctgaatggactcgagccatgtattcattcagtaaactgacattattctccca

SEQ ID NO: 152830 - DNA, 3338 bp, Homo sapiens
  Payload ID: 10058
  Gene Symbol: MARCH10
  Gene Name: membrane-associated ring finger (C3HC4) 10, E3 ubiquitin protein ligase
  ENST ID: ENST00000544856
  CDS Start-End: 380-2779
aggcaaggccggccggcgccgcggaaagcagcctcggggaaggaggaggaagaggggcaggtgtagggagtgaagaagcaaaaagaggaggaggaagaggagctcagggccgtccccgcgcaattaatgggcggctcctgcgccctggaccggcccgcccgcccagcccctcgacccctgtagccccggcaggggaggaagggcagacccacagggccagatgataaaccatgtgagatttcataactaccagaccagacgctgggtcaccatgagtccggggcggcctgactctgccaatatctgcacaactgaataaacaggaggagcgagggaatgccgcagaacgtatacacctgaaggtcagggattaggaatcatgttgcatgacgcaagggacaggcagaagttcttcagcgatgttcagtatctgcgggacatgcagcataaggtggactctgagtatcaggcttgtctgagacgacaggaatatagaagagacccaaatgagaagaaacgcgatcagttttgggggcaagagacaagttttgagagatcccggttttctagcaggtcatcttccaaacagagttctagtgaggaggatgctctaactgaaccaaggtcatctatcaagatatctgcatttaagtgtgactccaaacttccagcaattgaccaaacatcagtcaagcagaaacataaaagtaccatgactgtaaggaaagcagagaaagtggaccccagcgaaccctctccagaccaagcaccaatggttttattaagaaagaggaagccaaacctgaggagatttacagtcagcccagaatcgcacagcccgagagcatctggggacagaagcagacagaaacagcagtggcctgcaaaggtgccggttcccaggggagcagatcaagtagttcaacaagaaggcctgatgtgtaacactaagctgaagaggccaaatcaagagagaagaaacttggtcccatcgtcacagccaatgactgagaacgcccctgatagagccaaaaaaggagacccgagtgctccttcccagagtgagctgcatccagccctgtcccaggccttccaaggaaaaaatagtcctcaagtattgagtgagttctcggggccaccactcacacccaccactgtaggagggccaagaaaggcatcatttaggttccgagatgaagacttttattccattttgtcattgaacagcagaagagaaagcgatgacactgaagaggaaacccagtctgaagaatgtctgtgggttggtgtgcgctcaccctgttctccttcccatcacaaaagaagtagatttggggggacatcgacccctcaggccaaaaataaaaattttgaagaaaatgctgaaaattgcagaggtcattcttcaagaagaagtgagcccagtcatggctcattgagaataagcaatgcaatggagccagcaacagagcggccttctgctgggcaaaggttgtcccaagaccccgggctgcctgatagggaatctgctacagagaaggacagaggtggcagtgaaaatgcgaaaaagagccctctttcgtgggacaccaaatccgagcccagacaagaggttggtgtcaatgctgaaaatgtatggagtgattgtatttctgtggaacataggcctggcacccatgattctgaaggatactggaaagactatttaaacagttctcaaaattctcttgactactttatttctggcagaccaatatctccaagatcatcagtgaattcatcctataaccctcctgcatcattcatgcattctgctctgagagatgatattccagtagacttgtcaatgtcatcgacttcagttcacagctcagactcagagggaaactcagggtttcatgtttgccaaccactgtctcccattagaaataggactccatttgccagtgccgaaaaccataattatttcccagtaaacagtgcacacgaatttgctgtcagggaagcagaagatactactttaacaagccagcctcagggggctccactatatacagatctcttactaaatccacagggcaatttgtccttagtggattcttccagctcctctccatcaagaatgaactcagaaggccatttgcatgtgtctgggtctctgcaagaaaatacaccatttactttctttgcagtgtctcatttcccaaatcaaaatgataatgggagcaggatggcagcctctggtttcacagatgaaaaggaaaccagtaagataaaggcagaccctgagaaactcaagaaattgcaagaaagtctcctggaggaggactccgaggaggagggagacttgtgtcgcatctgtcagatagccgggggttccccaagcaaccccctcctggagccttgcggctgtgtgggaagcctgcagtttgttcatcaagagtgcctgaaaaagtggctgaaagtgaaaataacatcaggagcagatcttggtgccgtgaagacctgtgagatgtgtaagcaaggcctgctggttgacctgggtgactttaacatgattgagttctaccagaagcaccagcaatctcaggcacaaaacgagctgatgaattcaggcttgtacctggtgctgctgcttcacctctatgagcagaggtttgcagaactcatgaggctcaaccacaaccaggtggaaagagagaggttgtcaagaaattacccacaacccagaacagaggaaaatgaaagtaggttttgggggccagtcctgccattttgagggtgtttgctaaattactctttttctgtgactgtgtggaaccaaatgccatggaaggaaggaatgaccaccacccagaggcaaaaataaccccgcaaagcttgggaaagtcagccgcagcaaacaatcaggaaggcgaggccaagttcactggatgcagagcagataagaattttaattcatcctgaacgcaaggaaaggcgccaacaaagggaagaggttatcttccggcatgagataagatttgttccttttccttgctgggattctccagcgtccagcacttggagagtttgggggttggtttttttactgccaggattcctctaggaaaaccctccccaagccctggcaggggctgtctggcccttacctgaagggaccacattcactcacaagctagtggccttggtggatttggggtctgctgaattcagaggttgaacaaagcaaacaggtctcccaagaaagggccctcaaagcgggcaagacggctctctgcaaacaggttcgagaaaagccttctccctgttcctttttccattaaaaaaaaaaaaaa

SEQ ID NO: 152831 - DNA, 559 bp, Homo sapiens
  Payload ID: 10058
  Gene Symbol: MARCH10
  Gene Name: membrane-associated ring finger (C3HC4) 10, E3 ubiquitin protein ligase
  ENST ID: ENST00000583803
  CDS Start-End: 377-559
attactcgctcttgctttcagcaaggcaggaccccctccttccttctccacctgcctccaactccctcctcctttctctctccctacttaatatggcttcttatgttgatttctaaagcacagatttggcacaagacattatcaccagaaagacttaaaacagaagtgtgcataaccatgagtgggttttaaattaagaagcagttcaaagggccagatgataaaccatgtgagatttcataactaccagaccagacgctgggtcaccatgagtccggggcggcctgactctgccaatatctgcacaactgaataaacaggaggagcgagggaatgccgcagaacgtatacacctgaaggtcagggattaggaatcatgttgcatgacgcaagggacaggcagaagttcttcagcgatgttcagtatctgcgggacatgcagcataaggtggactctgagtatcaggcttgtctgagacgacaggaatatagaagagacccaaatgagaagaaacgcgatcagttttgggggcaagagacaagttttgagagatcccgg

SEQ ID NO: 152832 - DNA, 3214 bp, Homo sapiens
  Payload ID: 10058
  Gene Symbol: MARCH10
  Gene Name: membrane-associated ring finger (C3HC4) 10, E3 ubiquitin protein ligase
  ENST ID: ENST00000583600
  CDS Start-End: 286-2826
ggttgctagggaaaccggaggacgcccggtagccgcccccaccgcctccgccccaggcaaggccggccggcgccgcggaaagcagcctcggggaaggaggaggaagaggggcaggtgtagggagtgaagaagcaaaaagaggaggaggaagaggagctcagggccgtccccgcgcaattaatgggcggctcctgcgccctggaccggcccgcccgcccagcccctcgacccctgtagccccggcaggggaggaagggcagacccacaggtcagggattaggaatcatgttgcatgacgcaagggacaggcagaagttcttcagcgatgttcagtatctgcgggacatgcagcataaggtggactctgagtatcaggcttgtctgagacgacaggaatatagaagagacccaaatgagaagaaacgcgatcagttttgggggcaagagacaagttttgagagatcccggttttctagcaggtcatcttccaaacagagttctagtgaggaggatgctctaactgaaccaaggtcatctatcaagatatctgcatttaagtgtgactccaaacttccagcaattgaccaaacatcagtcaagcagaaacataaaagtaccatgactgtaaggaaagcagagaaagtggaccccagcgaaccctctccagcagagtcagagccgacttggtggaataaaccggaaacagacctcggaggaccttctggctggtgcagtctggggaagaaaggtcccatgagcagaagcatccctccctgtgaagcagaccaagcaccaatggttttattaagaaagaggaagccaaacctgaggagatttacagtcagcccagaatcgcacagcccgagagcatctggggacagaagcagacagaaacagcagtggcctgcaaaggtgccggttcccaggggagcagatcaagtagttcaacaagaaggcctgatgtgtaacactaagctgaagaggccaaatcaagagagaagaaacttggtcccatcgtcacagccaatgactgagaacgcccctgatagagccaaaaaaggagacccgagtgctccttcccagagtgagctgcatccagccctgtcccaggccttccaaggaaaaaatagtcctcaagtattgagtgagttctcggggccaccactcacacccaccactgtaggagggccaagaaaggcatcatttaggttccgagatgaagacttttattccattttgtcattgaacagcagaagagaaagcgatgacactgaagaggaaacccagtctgaagaatgtctgtgggttggtgtgcgctcaccctgttctccttcccatcacaaaagaagtagatttggggggacatcgacccctcaggccaaaaataaaaattttgaagaaaatgctgaaaattgcagaggtcattcttcaagaagaagtgagcccagtcatggctcattgagaataagcaatgcaatggagccagcaacagagcggccttctgctgggcaaaggttgtcccaagaccccgggctgcctgatagggaatctgctacagagaaggacagaggtggcagtgaaaatgcgaaaaagagccctctttcgtgggacaccaaatccgagcccagacaagaggttggtgtcaatgctgaaaatgtatggagtgattgtatttctgtggaacataggcctggcacccatgattctgaaggatactggaaagactatttaaacagttctcaaaattctcttgactactttatttctggcagaccaatatctccaagatcatcagtgaattcatcctataaccctcctgcatcattcatgcattctgctctgagagatgatattccagtagacttgtcaatgtcatcgacttcagttcacagctcagactcagagggaaactcagggtttcatgtttgccaaccactgtctcccattagaaataggactccatttgccagtgccgaaaaccataattatttcccagtaaacagtgcacacgaatttgctgtcagggaagcagaagatactactttaacaagccagcctcagggggctccactatatacagatctcttactaaatccacagggcaatttgtccttagtggattcttccagctcctctccatcaagaatgaactcagaaggccatttgcatgtgtctgggtctctgcaagaaaatacaccatttactttctttgcagtgtctcatttcccaaatcaaaatgataatgggagcaggatggcagcctctggtttcacagatgaaaaggaaaccagtaagataaaggcagaccctgagaaactcaagaaattgcaagaaagtctcctggaggaggactccgaggaggagggagacttgtgtcgcatctgtcagatagccgggggttccccaagcaaccccctcctggagccttgcggctgtgtgggaagcctgcagtttgttcatcaagagtgcctgaaaaagtggctgaaagtgaaaataacatcaggagcagatcttggtgccgtgaagacctgtgagatgtgtaagcaaggcctgctggttgacctgggtgactttaacatgattgagttctaccagaagcaccagcaatctcaggcacaaaacgagctgatgaattcaggcttgtacctggtgctgctgcttcacctctatgagcagaggtttgcagaactcatgaggctcaaccacaaccaggtggaaagagagaggttgtcaagaaattacccacaacccagaacagaggaaaatgaaaattcggagttgggagatggaaatgaaggcagcatttctcaaagccaggtcgtctagcaaggaagccaactgtggagctcggcggagacctctcccgccagcccttctttctacgtccccaagtgcctccctccctcctcctctttactgaaactgaaaccaaagcgttcacagttagattttcacctcgtgccactctcttttggggtctggcttgagcatctatgggcagccacagcgaccagtctagtcccagacagcacaggtcaagcagcgtgggactgtggagcccctggcaggctggcctggtgctgcccccttagcccagaagccctgccaggtccagtggcctggggtcccactgctgagggcacctgccaggcctcactccaccctgaatggactcgagccatgtattcattcagtaaactgacattattctccc

SEQ ID NO: 152833 - DNA, 718 bp, Homo sapiens
  Payload ID: 10058
  Gene Symbol: MARCH10
  Gene Name: membrane-associated ring finger (C3HC4) 10, E3 ubiquitin protein ligase
  ENST ID: ENST00000582568
  CDS Start-End: 1-495
gatgctctaactgaaccaaggtcatctatcaagatatctgcatttaagtgtgactccaaacttccagcaattgaccaaacatcagtcaagcagaaacataaaagtaccatgactgtaaggaaagcagagaaagtggaccccagcgaaccctctccaggtggcagcagcaagcaccccctgttctgtgttgaatacaccccttactgctccgtctttgctttctcccctgtcctgcagcccaataccaattactgctgcctcctcctgccactagtgccacctgcctccccagtggcccaggaacctcctgactgtcctctccctctggttaccgttccctccttcacaagcaccgcttccacctccccggaccccgtgcccgagtcccccgccgtgctgtgctacttccccatctcctgccccactccggctgagacccctgtgctgtgccttcagggccccagaaggcccagtaggatttacctcatgtggtaagtcactcttgcaaggcacacagcacagcgcagtcggggagaggggacttcgggcttccggaaggcaggtggacaggagaggggccagaggccacaccaagaacaataccaggcggcgtggtgttcgggggagcaggaagatgggacagcgtggccactgcactggggctgcaccttctagcgccaaaggagcgagcgaccaataaaatcccatcctctctgga

SEQ ID NO: 152834 - DNA, 2377 bp, Homo sapiens
  Payload ID: 10058
  Gene Symbol: MARCH10
  Gene Name: membrane-associated ring finger (C3HC4) 10, E3 ubiquitin protein ligase
  ENST ID: ENST00000580520
  CDS Start-End: 1-2082
atggttttattaagaaagaggaagccaaacctgaggagatttacagtcagcccagaatcgcacagcccgagagcatctggggacagaagcagacagaaacagcagtggcctgcaaaggtgccggttcccaggggagcagatcaagtagttcaacaagaaggcctgatgtgtaacactaagctgaagaggccaaatcaagagagaagaaacttggtcccatcgtcacagccaatgactgagaacgcccctgatagagccaaaaaaggagacccgagtgctccttcccagagtgagctgcatccagccctgtcccaggccttccaaggaaaaaatagtcctcaagtattgagtgagttctcggggccaccactcacacccaccactgtaggagggccaagaaaggcatcatttaggttccgagatgaagacttttattccattttgtcattgaacagcagaagagaaagcgatgacactgaagaggaaacccagtctgaagaatgtctgtgggttggtgtgcgctcaccctgttctccttcccatcacaaaagaagtagatttggggggacatcgacccctcaggccaaaaataaaaattttgaagaaaatgctgaaaattgcagaggtcattcttcaagaagaagtgagcccagtcatggctcattgagaataagcaatgcaatggagccagcaacagagcggccttctgctgggcaaaggttgtcccaagaccccgggctgcctgatagggaatctgctacagagaaggacagaggtggcagtgaaaatgcgaaaaagagccctctttcgtgggacaccaaatccgagcccagacaagaggttggtgtcaatgctgaaaatgtatggagtgattgtatttctgtggaacataggcctggcacccatgattctgaaggatactggaaagactatttaaacagttctcaaaattctcttgactactttatttctggcagaccaatatctccaagatcatcagtgaattcatcctataaccctcctgcatcattcatgcattctgctctgagagatgatattccagtagacttgtcaatgtcatcgacttcagttcacagctcagactcagagggaaactcagggtttcatgtttgccaaccactgtctcccattagaaataggactccatttgccagtgccgaaaaccataattatttcccagtaaacagtgcacacgaatttgctgtcagggaagcagaagatactactttaacaagccagcctcagggggctccactatatacagatctcttactaaatccacagggcaatttgtccttagtggattcttccagctcctctccatcaagaatgaactcagaaggccatttgcatgtgtctgggtctctgcaagaaaatacaccatttactttctttgcagtgtctcatttcccaaatcaaaatgataatgggagcaggatggcagcctctggtttcacagatgaaaaggaaaccagtaagataaaggcagaccctgagaaactcaagaaattgcaagaaagtctcctggaggaggactccgaggaggagggagacttgtgtcgcatctgtcagatagccgggggttccccaagcaaccccctcctggagccttgcggctgtgtgggaagcctgcagtttgttcatcaagagtgcctgaaaaagtggctgaaagtgaaaataacatcaggagcagatcttggtgccgtgaagacctgtgagatgtgtaagcaaggcctgctggttgacctgggtgactttaacatgattgagttctaccagaagcaccagcaatctcaggcacaaaacgagctgatgaattcaggcttgtacctggtgctgctgcttcacctctatgagcagaggtttgcagaactcatgaggctcaaccacaaccaggtggaaagagagaggattcggagttgggagatggaaatgaaggcagcatttctcaaagccaggtcgtctagcaaggaagccaactgtggagctcggcggagacctctcccgccagcccttctttctacgtccccaagtgcctccctccctcctcctctttactgaaactgaaaccaaagcgttcacagttagattttcacctcgtgccactctcttttggggtctggcttgagcatctatgggcagccacagcgaccagtctagtcccagacagcacaggtcaagcagcgtgggactgtggagcccctggcaggctggcctggtgctgcccccttagcccagaagccctgccaggtccagtggcctggggtcccactgctgagggcacctgccaggcctcactccaccctgaatggactcgagccatgtattcattcagtaaactgacattattctccca

SEQ ID NO: 152835 - DNA, 1741 bp, Homo sapiens
  Payload ID: 10059
  Gene Symbol: MARCH11
  Gene Name: membrane-associated ring finger (C3HC4) 11
  Uniprot ID: A6NNE9
  ENST ID: ENST00000332432
  CDS Start-End: 201-1409
ctccaccgaacggccgcgcctgccgccgccgcagctgcagaaccttccgcatcccctccccgtcccgccccctagccccaggcgtccgggccccctccctccttttcccctctccctcccgccccctccgcgctctctttccctgcagccagagcccggcccgccagccgggccggcaggagggcggcggcggcacaaccatgagctttgagggcggccacggcggcagtcggtgtcgcggggcggagagcggggacgccgagcctcccccgcaacctcccccgccgccgccgccgacgccgccgccgggagagccggccccggtccccgcggccccgcgctacctgccgccgctgcccgcgtcccccgagacccccgagcgcgccgcggggccaagcgagccgctaggggaggtggccccgcggtgcaggggagcggacgagctgccgcctccgcccctgcccctgcagcccgccggccaggaagtggcggcggccggcgactccggggaaggtccgaggcgcctcccggaggcggcagcagcgaaaggcggccccggggagtctgaggccggcgcgggcggcgagcgcgagcggcggggcgccggagaccagcccgagacgcgctcggtgtgcagcagccgcagcagcagcagtggcggcggcgaccagcgcgctgggcaccagcaccagcaccaccagcccatctgcaagatctgcttccagggcgcggagcagggtgagttgttgaacccctgccgatgtgatgggtcagttcggtatacacatcagctgtgcctgctaaaatggatcagtgagagaggttcctggacctgtgaactttgctgttatagataccatgttatagccattaaaatgaaacaaccttgccagtggcagagcatttctataacactggttgagaaagttcagatgattgctgtaatcctaggatccctgttcttaatagccagtgtgacttggctcctctggtcagccttcagcccctatgcagtgtggcagaggaaggacatcctttttcagatctgctatggaatgtatggttttatggatctagtgtgcataggtctcattgttcatgaaggagctgcagtttacagagtgtttaagcgctggcgagctgtgaatttgcactgggatgtgttaaattatgacaaagccacagacatcgaagaaagcagccggggagagtcttccacaagtaggactttgtggttgccattgacagctctgcggaacagaaacttggtccacccaactcagttaacctcaccaaggtttcagtgtggctatgtgttattgcacctgttcaatcggatgaggccccatgaagacttatcagaagataacagctcgggggaggttgtgatgagagtgacttcagtgtgacaaaagcataagatgatgcagtgtggaccaccctgcacattttgcaatgtaattgcagtgaatggcaaaaccatagcacttctaaaaacacatctatgaactttttaaaatttatgctttttatatgaacatttgaattgcaaatacatttttctgagaaaaagagtcctcttgttcttcgttgtctggtttgtcacatcttttataagttggtacttgaaatcattatacatataatttaactatacttggttaaaagaataatgaaagttatccttaaggccaaaactattttttcttgcttgttttaaatatatttttatgaaagcttt

SEQ ID NO: 152836 - DNA, 584 bp, Homo sapiens
  Payload ID: 10059
  Gene Symbol: MARCH11
  Gene Name: membrane-associated ring finger (C3HC4) 11
  ENST ID: ENST00000507111
  CDS Start-End: 1-164
agctgtgcctgctaaaatggatcagtgagagaggttcctggacctgtgaactttgctgttatagataccatgttatagccattaaaatgaaacaaccttgccaggtctcattgttcatgaaggagctgcagtttacagagtgtttaagcgctggcgagctgtgaatttgcactgggatgtgttaaattatgacaaagccacagacatcgaagaaagcagccggggagagtcttccacaagtaggactttgtggttgccattgacagctctgcggaacagaaacttggtccacccaactcagttaacctcaccaaggtttcagtgtggctatgtgttattgcacctgttcaatcggatgaggccccatgaagacttatcagaagataacagctcgggggaggttgtgatgagagtgacttcagtgtgacaaaagcataagatgatgcagtgtggaccaccctgcacattttgcaatgtaattgcagtgaatggcaaaaccatagcacttctaaaaacacatctatgaactttttaaaatttatgctttttatatgaacatttgaattgcaaatacatttttctga

SEQ ID NO: 152837 - DNA, 1376 bp, Homo sapiens
  Payload ID: 10060
  Gene Symbol: MARCH2
  Gene Name: membrane-associated ring finger (C3HC4) 2, E3 ubiquitin protein ligase
  Uniprot ID: Q9P0N8
  ENST ID: ENST00000215555
  CDS Start-End: 171-911
ccggacgcaggtgccggccggagcggagctagtggcgccgacgggccgggccgggccgggaccggggccgaggcgaaccgaggggcctgtgcggccgcccggcccggccgcggatcaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtccccgtgtggctgcaccggcacgctgggtgccgtgcataagagctgtctggagaagtggctttcctcatctaacaccagctactgcgagctgtgccacacggagtttgcagtggagaaacggcctcgacccctcacagagtggctgaaggacccggggccgcggacggagaagcggacactgtgctgcgacatggtgtgtttcctgttcatcacaccgctggccgccatctcaggctggttgtgcctgcgcggggcccaggaccacctccggctccacagccagctggaggccgtgggtctcattgccctcaccatcgccctcttcaccatctatgtcctctggacgctggtctccttccgctaccactgccagctgtactccgagtggagaaagaccaaccagaaagttcgcctgaagatccgggaggcggacagccccgagggcccccagcattctccactggcagctggactcctgaagaaggtggcagaggagacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcagagcctagtctgtgatcctgtgtgaagatattttcagggtttttttttttttttttttgcatatggaggacaggtggacatggtcctgagctctggacggagcaggcaccctgatctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaatgaataaaaggagccctggctgg

SEQ ID NO: 152838 - DNA, 1192 bp, Homo sapiens
  Payload ID: 10060
  Gene Symbol: MARCH2
  Gene Name: membrane-associated ring finger (C3HC4) 2, E3 ubiquitin protein ligase
  Uniprot ID: Q9P0N8
  ENST ID: ENST00000381035
  CDS Start-End: 204-734
ggtccgcggcgctgtcggctcggcgggcggtgcccggacgcaggtgccggccggagcggagctagtggcgccgacgggccgggccgggccgggaccggggccgaggcgaaccgaggggcctgtgcggccgcccggcccggccgcggatcaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtccccgtgtggctgcaccggcacgctgggtgccgtgcataagagctgtctggagaagtggctttcctcatctaacaccagctactgcgagctgtgccacacggagtttgcagtggagaaacggcctcgacccctcacagaggtctccttccgctaccactgccagctgtactccgagtggagaaagaccaaccagaaagttcgcctgaagatccgggaggcggacagccccgagggcccccagcattctccactggcagctggactcctgaagaaggtggcagaggagacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcagagcctagtctgtgatcctgtgtgaagatattttcagggtttttttttttttttttttgcatatggaggacaggtggacatggtcctgagctctggacggagcaggcaccctgatctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaatgaataaaaggagccc

SEQ ID NO: 152839 - DNA, 747 bp, Homo sapiens
  Payload ID: 10060
  Gene Symbol: MARCH2
  Gene Name: membrane-associated ring finger (C3HC4) 2, E3 ubiquitin protein ligase
  ENST ID: ENST00000601283
  CDS Start-End: 440-562
ggacgcaggtgccggccggagcggagctagtggcgccgacgggccgggccgggccgggaccggggccgaggcgaaccgaggggcctgtgcggccgcccggcccggccgcggatcagagactggagactgggtcttgctctgttacccaggctggagtgcagtggtgtgatcatagctcactacagccttgaactcctgggctcaagaggttgaggctccctcctcagcctcccaagtagctgggactacaggctttcagcaccatgcctggctaattcaaaaaaaccttcagagagatagggtctctctatgttgccctagctcgtctcaaactcctggcctcaagtgatcctcctgcttggacctcccaaagcgctgggattacaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtgacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcagagcctagtctgtgatcctgtgtgaagatattttcagggtt

SEQ ID NO: 152840 - DNA, 865 bp, Homo sapiens
  Payload ID: 10060
  Gene Symbol: MARCH2
  Gene Name: membrane-associated ring finger (C3HC4) 2, E3 ubiquitin protein ligase
  ENST ID: ENST00000595213
  CDS Start-End: 697-865
taggcacgggcctgcaggtagggccggaggacgccagtccgcgggccggccccgggttcgaggccggagctcggcacccgggcgggacggctgggctcgatcccttggccacagccttctcggggacgcggggacctcagttcccgtgtcaaggccggtgggaggtctccggggtccggcacacataggcgcctctccgagcctcggtttccccacctgtgaaactgggtcatcccattgccaacctgatggggcttctgggaggattcaggaggtggctggtgcagaaaacgcctgacacacagtaggcaactgctaagtggccaatgcccttccccaacctccttctcagagcggctctgcctgcaaaataagactggagactgggtcttgctctgttacccaggctggagtgcagtggtgtgatcatagctcactacagccttgaactcctgggctcaagaggttgaggctccctcctcagcctcccaagtagctgggactacaggctttcagcaccatgcctggctaattcaaaaaaaccttcagagagatagggtctctctatgttgccctagctcgtctcaaactcctggcctcaagtgatcctcctgcttggacctcccaaagcgctgggattacaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggaca

SEQ ID NO: 152841 - DNA, 1667 bp, Homo sapiens
  Payload ID: 10060
  Gene Symbol: MARCH2
  Gene Name: membrane-associated ring finger (C3HC4) 2, E3 ubiquitin protein ligase
  Uniprot ID: Q9P0N8
  ENST ID: ENST00000602117
  CDS Start-End: 456-1196
catttatccagcagtgaaccgtcctagcgcaagagttagtaattgctcccctgttccttcacctccccactttggagctcagatttgtttttttgtttgtttgtttgcttgctttcttttgttctgttttagagactggagactgggtcttgctctgttacccaggctggagtgcagtggtgtgatcatagctcactacagccttgaactcctgggctcaagaggttgaggctccctcctcagcctcccaagtagctgggactacaggctttcagcaccatgcctggctaattcaaaaaaaccttcagagagatagggtctctctatgttgccctagctcgtctcaaactcctggcctcaagtgatcctcctgcttggacctcccaaagcgctgggattacaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtccccgtgtggctgcaccggcacgctgggtgccgtgcataagagctgtctggagaagtggctttcctcatctaacaccagctactgcgagctgtgccacacggagtttgcagtggagaaacggcctcgacccctcacagagtggctgaaggacccggggccgcggacggagaagcggacactgtgctgcgacatggtgtgtttcctgttcatcacaccgctggccgccatctcaggctggttgtgcctgcgcggggcccaggaccacctccggctccacagccagctggaggccgtgggtctcattgccctcaccatcgccctcttcaccatctatgtcctctggacgctggtctccttccgctaccactgccagctgtactccgagtggagaaagaccaaccagaaagttcgcctgaagatccgggaggcggacagccccgagggcccccagcattctccactggcagctggactcctgaagaaggtggcagaggagacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcagagcctagtctgtgatcctgtgtgaagatattttcagggtttttttttttttttttttgcatatggaggacaggtggacatggtcctgagctctggacggagcaggcaccctgatctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaatgaataaaaggagccctggctggacaaaa

SEQ ID NO: 152842 - DNA, 485 bp, Homo sapiens
  Payload ID: 10060
  Gene Symbol: MARCH2
  Gene Name: membrane-associated ring finger (C3HC4) 2, E3 ubiquitin protein ligase
  ENST ID: ENST00000601724
  CDS Start-End: 245-485
ggcggtgcccggacgcaggtgccggccggagcggagctagtggcgccgacgggccgggccgggccgggaccggggccgaggcgaaccgaggggcctgtgcggccgcccggcccggccgcggatcagctcgtctcaaactcctggcctcaagtgatcctcctgcttggacctcccaaagcgctgggattacaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtccccgtgtg

SEQ ID NO: 152843 - DNA, 690 bp, Homo sapiens
  Payload ID: 10060
  Gene Symbol: MARCH2
  Gene Name: membrane-associated ring finger (C3HC4) 2, E3 ubiquitin protein ligase
  ENST ID: ENST00000595142
  CDS Start-End: 455-690
cggcgggcggtgcccggacgcaggtgccggccggagcggagctagtggcgccgacgggccgggccgggccgggaccggggccgaggcgaaccgaggggcctgtgcggccgcccggcccggccgcggatcagagactggagactgggtcttgctctgttacccaggctggagtgcagtggtgtgatcatagctcactacagccttgaactcctgggctcaagaggttgaggctccctcctcagcctcccaagtagctgggactacaggctttcagcaccatgcctggctaattcaaaaaaaccttcagagagatagggtctctctatgttgccctagctcgtctcaaactcctggcctcaagtgatcctcctgcttggacctcccaaagcgctgggattacaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtcccc

SEQ ID NO: 152844 - DNA, 4196 bp, Homo sapiens
  Payload ID: 10061
  Gene Symbol: MARCH3
  Gene Name: membrane-associated ring finger (C3HC4) 3, E3 ubiquitin protein ligase
  Uniprot ID: Q86UD3
  ENST ID: ENST00000308660
  CDS Start-End: 516-1277
gagtcccgcagcgcccgccggcagccacggcacttcgcaataaccaacttccccgccgccggcgcgtcccgccagcctgccctcggccgcaggcgactggacggcggttacggggcggtcccagcgccaccacgactggctgtcggctccgccagtcatgggctgatgacgccccggggctggctccgcccctagcggcagccccgcctcccctccagagcctggtcggcttagccctgctttccgcctcactcgttgagcaggtccgtgaattgtcagcgcgctgtgggcgactgtgtggccgcggcggccgccaggcttgccgcactccccctgaggtgcccgccggaaccaatgtgccctggtccactgggccgtgagcagccaccgactgggggcaacttggcacttagaaccgcagcagggacgtcggtttgctatcgggactcggcgaggacgatggaaatcctgtatgaatgtggaagccattagcagagtaattgctgtctgttaccatgacaaccagccgctgcagtcacctgcccgaagtcctgccagactgcaccagctcagctgcacccgtggtgaagacggtggaggattgtggcagcctagtgaatgggcagccgcagtatgtcatgcaagtttcagccaaggacgggcagctgctgtcaacagtagtgcggactcttgccacccagagccccttcaatgaccggccgatgtgcaggatctgccacgagggcagcagccaagaggacttgctctctccatgtgaatgtacagggaccttggggacaattcatcggagctgcctggagcactggctgtcatcctcaaacaccagctactgtgaactctgccacttcaggtttgcagtcgagcgcaaacccaggccgttagtggagtggctgagaaaccctggcccccagcatgagaagcggactctgtttggcgacatggtgtgcttcttgtttataactcccctggccaccatctcgggctggctgtgcctgcggggcgccgtggaccacctgcactttagtagtcggctggaagccgtcggactgattgcactcactgtcgcactcttcactatttacctcttttggacactagtgtcatttaggtaccactgtcgattgtacaacgagtggcgtcggaccaatcagagggtgattctcctcattccaaagtctgtcaatgtaccttctaaccagccgtccttgctgggcctccattcggtcaagaggaactcaaaggagacagttgtttgatgtttgtatggttggttggttgtttgattcattgtttggggtttggaagtgtctgcactggggtcatgcactgagcgacccccaagcccttccttaagcctgtgggtctaagaacatccagagcatattagcacatcactccaagcaacaacctccgccagaagaaagcaaatgctgttttacttcaaatgatggatgctgcaatcatatgatatttgctaagctgccaaacatgtttatttagcagatactgtatggaattttctgaacacctctttaacgtatgaggaaggttgtcctgctacggatgcaattcaattcttccttttttattactatttcaaacacacacacatatatatatatattaaacttagatgataatcaaaatcaaaaagtcaacgtaaaaactggtttcttggtttggttgggtcttatttgagttagtttgtttctcagtttctcgtatggattctttggggtactttggtagcctgagtggtctttttcatctctttcgcgtccattactcaaggagacagcataacagatgcagaacaagtcatatttgaagaatgttttgtactaaacttcatttaattattcagtttttaaagggaaaaagggcgtgagctcacacagtgagctgtttatttaaatatcattaaggagaaaaaaaaatatggtgagaagctcgctcctttcaacttgtttggtactgacagctgatagaagctattttctaataataaacatccagtgtgtgaaagacaaaacccactgattgcaatactctttttttaatgataaaacctgtgaagtttcccaaagcaggttttaaaaggaaaaaaaggaaaagcaaaaaggttgctgttctcactcccatctcatttagtgcatgtcttaattcgggattcgtaatgaattggaggatcattagacatttctaggaaccctagacctgttttgcatgtcaattagcattcccattgctctattgaatttctagcttgacaggtagatgtggcaaaaaaaaaaaaaaaaaaaaaagcctgtcctagcagccctgcacttattctaagacccctttgtctgattctttaaaaaggagccccacacagtgccttcccccaaccatgagccaattctgtcacagtccgaaatagactttttctaagggtttcgtgtccctcttttatccgtcgcagtgtaaagggtctgatccgcagcctgcattgtgcgcgcaccgaggcaggagcggatgtcttctgaggagagcgctggctggggttgactctcaggctcccggctgtccgcccgcccacacgcagcgaggaggggcggagccctgcttccggaatgcttaaaatatggaattctagaacatgacccacattctgagtatcactccagcatctgccttgtgttccaagtgggaaaacgagaagtgcaaaggaacaggcagcgaggagggtagcgatttttgtctgcaaattgatggagctgatgcaggtgtcccctttgtaggcgagccctccattcactggctgctcccagcgctgcctggggagggaaacagctgtactgctctccgctgcaaaactcagatgtgctttatggcttgtgacaatagatttcctccccaccacgcttcactgggacacttcaattccagtaatatatgtctcagcccttctgtttactgcgccctgctcacccccctgggctgtcattagctgcaccaccatcaaccgtttcttaattgacctttttaaaatgctggacatcaccggctgcacgcagctgccacacattaaatttccagagcaaagagtccaacttggtagctggtgaattgcagccctgtaatatacttaataaatgacgtccacccagccttagtccctgagctgtcaggtgaacccgtgacacgtctcaactgaatggcacaacattcatgagaggaccataccccttctccctgtttcttgcatgaattaaggaagcagcggatttccaggatgatttcctgtcaaggttggctgcagagaattcctgccatcttggttcatgagatgagatatgacatcatcaaaggcagccaggtcccaggccgttcaatggggatcctgcattaggaagggtttgcacattaaaactgtgcctgtgccacacctctttccttcgtgtttgcatccctgccctgtgaagtaaaacagagtccaagatgcaaggagtagattgtgtgtggggtggtgaaaggacacccctggcagccaggcagagcatcagtgcctcccttcccaggtcaccagcttgggacctccttgtgagaggctctgatctccatcagcatcagggcccataggggattctgaactcttggaggatatttcatcccctccaagccttgccccatggaaagggctacacctcctgcaggaaggggtgccttttgttaacaggtattaatgggtacagaggcaccatgcagcctaccagcacccttgctagcctagtcctcttcctgtgcttctttttgaaagatcaagaatgaagaggaagagatgaggagtgggggtcctttacctaaaggaccctcgtggttcattgcttctctttaactgactttttaaaaaaactccctcttccacactccttgctgtgattctgtcctaatcatttttcttgagaatgtcatgtagagataaatgtgtgtcacagtgaagccagaaggtgaattaacaactaagacaaatccagcatgctcttgcctgccctgcatatgtgctcatttggggaaggacggaggacacagagcatcgacacaaattctacagctcctcagagaacacagcagagactcagatgagctgtaaaatccattaaggaaaaataaatggcatgatttggaagtta

SEQ ID NO: 152845 - DNA, 719 bp, Homo sapiens
  Payload ID: 10061
  Gene Symbol: MARCH3
  Gene Name: membrane-associated ring finger (C3HC4) 3, E3 ubiquitin protein ligase
  Uniprot ID: Q86UD3
  ENST ID: ENST00000515241
  CDS Start-End: 58-474
gatggaaatcctgtatgaatgtggaagccattagcagagtaattgctgtctgttaccatgacaaccagccgctgcagtcacctgcccgaagtcctgccagactgcaccagctcagctgcacccgtggtgaagacggtggaggattgtggcagcctagtgaatgggcagccgcagtatgtcatgcaagtttcagccaaggacgggcagctgctgtcaacagtagtgcggactcttgccacccagagccccttcaatgaccggccgatgtgcaggatctgccacgagggcagcagccaagaggacttgctctctccatgtgaatgtacagggaccttggggacaattcatcggagctgcctggagcactggctgtcatcctcaaacaccagctactgtgaactctgccacttcaggtttgcagtcgagcgcaaacccaggccgttagtggaggtcagtaagtggggcacgtcctgaaaacttagctctaatgagcaaatgatgtctgtttttatgcctggatcacaagccctgtacagctttactgaagcacggtaatagctatgtgactgtgtgtgtgtgtgtgtgtgtgtgtgtgtgtgtgtgtgtgtgtgtttgagaaagagagatgtagacagacagacacagagaagggagagcttgctagctcacttgggatccagcagtagaaggaaagcagaataaattagtataaggagaaa

SEQ ID NO: 152846 - DNA, 4447 bp, Homo sapiens
  Payload ID: 10062
  Gene Symbol: MARCH4
  Gene Name: membrane-associated ring finger (C3HC4) 4, E3 ubiquitin protein ligase
  Uniprot ID: Q9P2E8
  ENST ID: ENST00000273067
  CDS Start-End: 1768-3000
cccacctcggccacactgcttcgctcccccctccccaccttcagctggcaccgcaaacaagccttacctcgttgcatctgcgaggagaggtagcaacagcgagcctagccagccagaggcggtggagaggaggaaggggcggggtgggggggcagagagcgggccgaggccgcccttggtgggggtagcgggggcagagctgccgagcagacccggcagccgccctcctccgcccccaccctccagaagcactcttgcctgagaaccgaattattccactagtattatttcattttttattactccccctcctcactccccagccgcccccacccccacgccggcctcgcctctggttgcatggcagcgctgcccgggcgcgggggctcagggctggcccccagggaagggggaggaggaggaggatcatgaaggccggagtcgcgaccgcgccggacggcgggcagcagccagaggacgagccggagcagcccccgccccggagacacccggacgccgagcagcagtcgcctccgccgccgcagcagcagctgcgggcgcgggccgacccggagccggaggaggagggcgaccgcgacccagaggaggaagaggaggagaaggcgaggccactcgcccgcccggacctgcccttctctcggctcttgcccctcgaccgaagggacctttgatggaaccgaggggagggcgccacggatttgccgactgcagcaggggtgggctgggggctgagataatgtaaccactcctttctcctgttctctcccacacgcccctctcctctacccctattctctgctccactgccctctcaccccggtacacacacccttcctctagccaggatcttcatgctcaggaaggaggcgcctctgcaagggttaaacgatcttttctttttctcccatcctttttccttcccaaacctctattttacctcccttctcctaattggctttcccctcttcggtgtaaccctttggctgcggaggcaaagcacaagcccctagcccagtttcacctgcaacacccctcccccacccaactgctctcttaaaagcaactctggtgcttctgggggttaattgccccagttttctgcccaggagaattaaaacttctcccaatcttctctcctcccctaccttgactcccccaacccctaccacctgagaaaaacgatcttttctctctcacacatgcagtcctcaattcttcattgagctagttttctctaagcccagctcaatccactccagatttgatttacaattgtccccacccttttatataaaagaaagatttctcactgcgtaggaatttgagaagaacccaataatcctttcctggggaacttttaaacaattcgacattgatttaaacaattcgacagaggctctagtggcccctccaccacgcttcttcaatccctctgctcctaccagtgtcctcaggtcaaaagcagaaaggagacacactgaacaaagttggaggttggggtgggtgtgtgagggcaagaaaaacttttttgttattgggctttccaggtggagttcagaaccagtgactcacacttctcagtcctgggagcaatttatttgctacttggaggggttgtaagaaaagccagtgagaaagcagactccccccacaacacagatccactgtggacccccaaaacctgtcctgtccccctcttttaagactccagccacccctcttgggctctctacttccacggggcacatgctgatgcccctgtgtgggctgctctggtggtggtggtgctgctgctccggctggtactgctatggattgtgtgccccagccccccagatgttgcgccaccagggtctcctcaagtgccgctgccgcatgctcttcaatgacctgaaggttttcttactgcggcgccctcctcaagcgcccctgcccatgcacggcgacccccagccccccggtttggcggccaacaacacccttccggctctgggcgccggggggtgggcaggctggaggggcccccgagaagtggtgggcagggagccccctcctgtgccacctccaccccccttgccaccttcttctgtggaagatgactggggtggcccagccacagagccacctgcctcgctgctcagcagtgcctcctcagatgacttctgtaaggagaagaccgaggatcgctactcactgggcagcagcttggacagtggtatgaggaccccactctgccgcatctgcttccaggggccagaacagggggagctgctgagcccatgccgctgtgatggctcggtcaagtgcacacaccagccttgcctcatcaagtggatcagcgagcggggctgctggagctgcgagctgtgctactacaagtaccacgtcatcgccataagcacaaaaaatcctctgcagtggcaggccatctctctgacggtcattgagaaggttcaggttgcagccgccatcctgggctccctcttcctcatcgccagtatttcttggctcatctggtcaactttcagcccctcggcaagatggcagcgccaagaccttctcttccagatctgctacgggatgtatggcttcatggacgtggtgtgcataggtctcatcatccatgaaggaccctcggtgtaccgcatctttaaacggtggcaggctgtcaaccagcagtggaaagtgctgaactatgacaagacaaaagacctggaggatcaaaaggcaggaggcaggaccaacccccggacctcctcatccacccaggccaatatcccctcctcggaagaggagaccgcaggcacccctgcccctgagcagggccctgcccaggctgccggccacccctcaggccctctgtcccatcaccactgtgcttataccatcctgcacatcctgagtcacttgagacctcatgaacagcgaagtcccccaggcagcagccgagagctggtcatgagagtcacgacagtgtgagagcagaggcccggaaggaaggccatgaccaccactgagggcccggagcagggtggggaggtgcagtggcacccccagagccaacagagggagcaggcagagggtgggggacctggcgggagccctggggtagtgtcagagcgggagtgaggctggtgcaggagcagttctgctatttccaatcagtcaatgccactctccacaacaacaatgaaaaccaacaccaactcaacaacaaagtgcaatacaggctgaacctggcccaacagaaaaaccctgccccaatgcacctgcaggcaaggtacccgaagaagcagaggctgagggcaggcaaagcctgtgtgactgtggcagtgccggaggccaagggggccaagaggaaaagcatctgtggtctgctctgctctcaccctgtttggttttgtttctcctggggctgtgttctgcaggcagccagaaaaggaggaggcacgggtgagctggcagggacacactgcctttggggctcctgggctcatttggatgggcaagattcgctgacaaatggctgtggggatggtggggtggatggtcagggagggatgctcagggagggatatgctggtgtgagcagccagagggagagtgtgtctccttcctgaaggaacttccaaatggaactcccgatttcaggtgggctaaaagagggcttaggtttggaaaagggtgtccttctgtgcccttgttaatttattttatagtgatttggttcaaagatgtttacaggacacacacacacacacacacacacacacacacacacacccctagagaaaagtacagatttccagtggatatttcaagcacagttctgctgctgtggcttcagctttggaagctgtcaatcccggagcaactttcccaactacccaaccccaccatggccaggacatgtgcaatgccagccccttcttgtcttggcacatgcacagacccagtcccctcacggtagggcacccctgacctacgggcttccaagagagcagctgcagtggttgggaggagcttgaccagtgtgccccaaggagtggagtagagcccaatctaagtattccttgctgcttggaaccctccctgtttggaaccctccccaaagaggcagtcaggctgatgctcagtgctttgtgctccctgctccttcccgcgtagccaggtgggcccaagggtgcctggcagggagcactacccctggacccctcctgctcgctctggggaccctgccagggaaggccactgggtgttcacctgcaaagtttctggttgtcactgcacagtggtcgcgtcatccatgggtattaaaaggacactgtcaagtacttttttaaactagtttttagggttttttaaaactctctgttgtttgtaatattctcttaaaagcttgaaaataaaacttctttccctacca

SEQ ID NO: 152847 - DNA, 3926 bp, Homo sapiens
  Payload ID: 10063
  Gene Symbol: MARCH5
  Gene Name: membrane-associated ring finger (C3HC4) 5
  Uniprot ID: Q9NX47
  ENST ID: ENST00000358935
  CDS Start-End: 333-1169
tcttacctcacaaaggtagctcctccgccggcagcaactcggcgcccgcggtccatggaccggaacctcgggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacagaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttc

SEQ ID NO: 152848 - DNA, 9569 bp, Homo sapiens
  Payload ID: 10064
  Gene Symbol: MARCH6
  Gene Name: membrane-associated ring finger (C3HC4) 6, E3 ubiquitin protein ligase
  Uniprot ID: O60337
  ENST ID: ENST00000274140
  CDS Start-End: 133-2865
cctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatatatatatatttttttttttttttttttttttttttttttgcccccgagacagagtcttactctgttgcccaggctggagtgcagtggcacgatcctggttcactgcaccctctgcctcccaggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgtagtctagtttttttgtttgtttttgtgttattgcaagattgctttaagattgcagaaatatgcattattagccagcatagataatccagatgttataataggaaggaaaaacaactccagttaaatgtgactgtggcgactcccttttatgtatacatttaaatgcatagttgcagaggacacatccctccccttctgtctccctaacttgaactgtagaccgtcctcactgggaagagtaaggccccacattttgtgcaatagcaagctactgcccacttctgcatgtctgctacgagatcagaaagtcagtttcactaaggttgtcttttagctgaatacttagagtaaaaccaatcaaatccattgtacatacctgaccatatgtcccagataaaaaggaaagacttgcgtgatgtttttttccttctgagtgccctgaggagatccttttgcttcagactatttctaatttttctttgtttataggttcagaattttttccatgattgttttcccccaaacaagtgcatttttaattactttaaatgcaggggtgatagaggaaatgctattcgaaccatagacatctttaatctgtgaagctgaaatttttcagcaaaggaaattgcatggtcaagttcagaaactggccattaatttcccccttccgctccacagttcatagctactcttgttgcaaacatgtagtgataaggagaactaacgtatcaaggggctgagagggtaacgttcccctcctcctccatgtttttattttggtgtctgttttgtttctagcactgtatttagtactgtagttgaatgaggtatgatgtctcccttcaaggaactcagaatggaacagaagcatgagcaaaagattgtattacagaggtatgaataaaatgccatggggaacacagagaaaggttcacccgggagagatggcctagccacttccttagtgactgtttggtatatgtaggtccccctgccattactctttcagccttctgcaatctagttctacttagtcacacacttctctaagaccactcatacgtaaacactacgtagaggcccctttttgcctcattttacattgtttagttatcattttgaaacttttcttcacatatgtaacagtgccggagtttttctgcttctctgtgtttgttcagtaactcttctttaggatacacctaaagatgagaagcttcatacccagtactcctcttcattcactcatatgtttttgggatcagtcccttctgctggctgtgcattggtctaatggaacagaatagagtccagaaataacccaacatgtatgtggacaactggtttttgacagaggtgcaaaggtcttgaaaaaatgatgctggaataattgggcatcagatgcaaaattaaaaacaaattgatccatatcttaacactggcaaagattaaagtccaaatggattatagttccccaaaactgtataatttctagaagacaacaaggaaaacgtgttcagccttgggttaggaaaagatttcttaaatccaacaccaaaagcacaatccatgaaggaaaaatcgataaattgtactttatcaaaattgagaacttctctttgaaaggtaccataaggagaacaaaaagacaagctgtagagtggcagaaaaatatttgcaaaacatttctgataaatgagttgcatctagattacataaagaagtctcaaaactgaacaagtaaacccattgtttacttaatcgctgtttctcctgagcttgctgcctctgcccctgctctctctccttttccatttgttttcaacattgaatccagaatgttcttcttgagatccaagtcagatcacaccaaccctcagaactctccaatagacgaccatggcactcaaaagtccacaatagccttcaatgctgggcaaaacatgaagcaccccttttctcccttctctgaccccatcacctctgtgttcaccctgctcctgccgtcctccctgcctccaaaacaggtcaggccttcgtgcctttgcacttactatttgcaatacccaaatgttcttcaggctctttagcctcttcatttctttcctgaagtgtcattctcactgaggcttatctaaagctgcagctactggggcattcctgtctcatctccctgctgtattttgtactcccggctctcttttgtacttttaaacatactatatggtttacctttgttgtttatatttgcatgttgtttcccacttgaatgtaagctccaaagattttatttttttaaactgaattattactgtattcccagaacaattccctggcaaatatttggtactcaatagtaatgctaagttagtaaataaatgatgaatttagaatcaaaataatgtgtctatggccaaaataaaacctgaaatccctgtcctatttcccagaggtaactgctgttaatagtttagttgtgtgcttccagacataccttcacagaatcatttatcacaataaaggtgtcatactatgca

SEQ ID NO: 152849 - DNA, 3062 bp, Homo sapiens
  Payload ID: 10064
  Gene Symbol: MARCH6
  Gene Name: membrane-associated ring finger (C3HC4) 6, E3 ubiquitin protein ligase
  Uniprot ID: O60337
  ENST ID: ENST00000449913
  CDS Start-End: 197-2785
ccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaagccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaac

SEQ ID NO: 152850 - DNA, 1963 bp, Homo sapiens
  Payload ID: 10064
  Gene Symbol: MARCH6
  Gene Name: membrane-associated ring finger (C3HC4) 6, E3 ubiquitin protein ligase
  ENST ID: ENST00000510792
  CDS Start-End: 137-1963
cttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataa

SEQ ID NO: 152851 - DNA, 2874 bp, Homo sapiens
  Payload ID: 10064
  Gene Symbol: MARCH6
  Gene Name: membrane-associated ring finger (C3HC4) 6, E3 ubiquitin protein ligase
  Uniprot ID: O60337
  ENST ID: ENST00000503788
  CDS Start-End: 184-2601
gtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaaggccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatcttt

SEQ ID NO: 152852 - DNA, 580 bp, Homo sapiens
  Payload ID: 10064
  Gene Symbol: MARCH6
  Gene Name: membrane-associated ring finger (C3HC4) 6, E3 ubiquitin protein ligase
  ENST ID: ENST00000502795
  CDS Start-End: 189-422
ctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaaggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgtt

SEQ ID NO: 152853 - DNA, 5922 bp, Homo sapiens
  Payload ID: 10065
  Gene Symbol: MARCH7
  Gene Name: membrane-associated ring finger (C3HC4) 7, E3 ubiquitin protein ligase
  Uniprot ID: Q9H992
  ENST ID: ENST00000259050
  CDS Start-End: 123-2237
ggtggctggttctgcgccggatccgggagaggggcgggcgccattgtgcttcgctgccgactgcatttcctcagtcacgggcctagaactccaaggagaaaggcggcgaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggactccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccctccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttactgtttgaaatgtttccttttaaactggtgctcaaagaagacatcagacttcataaccaagaattttattacaatttcaaatctcattttaagcaataatataaatgttctaaaacatttgctcacctcttgccagttacctttgcattgtctgtcttaaagcaaaaatataaaatttaagggtggtagttttaatatattctgtgggtcctaagggatgctttgaatttgaagtatatatacttttaataaaattcagtatgacagttgtcttctgcttaacccataaaactttatttaaaaaatttaactagatggtacaaaacattcattggtatgcacataattctgtatagttttgttattaaatgctaaatgacagtgataacaatggcttaagctttacagtattcttgtagttccctagtaccacttagtatttaaatattgtcatattagcttcagattatcatgtaaatgacggtagaggaataagagaaaaggctttcattggttatcagttttaaattctgaacaaaagagaccatacactgctcactacaagaatgcaattttctaagaaaatgtagtttaaaatgttattctgaatatctgccaaagaattatattgttattactagctagaaccaagatgttgaagaaagcagtttctacattctggatgtagtaaacaagcctgcctgtgtaatccaattatctcttcactaatgagtagataaggtgcctgttatagatgttctggtatataaagaaaaaatgtaggccaagtgtggtggctcacgcatgtaatcccagcactttgggagaccaaggtgggtggatcacttgaggtcaggagtttgagaccagcccagtcaatatggcgaaaccccgtctctaccaaaaatacaaaaagttagctgggtgtggtgacagatgtctgtggtcccagctactaaggaggctgaggcaggagaattgcttgaaaacctgcaaggcggagattggagagagccaagatcgagccactgcactgtagcctgggcagcacagtgagactccatcatatatatatatatagcacttcattaccagaggcctcttggcctgttgaaaaatgaaaccaaatattgaaaattaaatcagagtttaaagcagctattttggaagagctgccattaggtagaaagtatcaaaatgtacaaaagaaagttgtatgggagttgagtggaaggtaggatttaagagcagcactgcccaataaaacttcctataatgaaaatgttctataatgtatgttgcccagtacagtagccactaaccacctgtgatttgaacacttgacaatgtggctaatgtaattcgaaaactggattttaaactaaatttacttaaatagcctcatgtggctagtggctcattggacattgtagttgtagacgtttgagactgttggttttaagttggacttaatcactttcctacccaaattctaccactcctttaagaactcctttagaactcttttagttcacataatacgccatattttttttactgtgcctgtagttcttcaaggagtggtacaatttgggtaggaaaaccaggcaggaattccagggtagtgttcaatattgacattagtaatagtctatcaataataaaatagacatctcaatcactatacaaaatctcagaaatgtaaagctcttacagagcatgcttgtgcttgtgtaacagctggtgtaatgcctgcattttcagtaccatgtagccgcactgttaatagttttctatcactttttagttactcatgtctcattaatgatagtgccattaattgtgatgagtgttttcgattcatgtggtcaataaaaagagactacacaagctggaactttgttgccattagtcaagctagtgagatagtatatctatctatctccccagaagaaagtaagataattgatggggtgtggattcagaagagggattacttttctttgagcctcagacttctagacagtatacttcagtcagtaatggaccacatatagaacagtgtttccttagtagaccatatttttactgtaccttttctatatttagatacacaaatattgtgttacaattgtctgcagtattcagcacagtaacatgctgtgtaggtttgggacaaaataggctctaccatctgggtttgtgtaaatacaagctgattttcacacaagattccctaactatgcatttcttagaacgtatccccattgataagtgatacgtgactaatttacgtgaaatttatacattctttatctttcctgtttttggtttattgatggtgaggaaaattactcgtttcagctttttcatttttttactccccaaatgattttcacctttttcttaaaatgtacaataaatgcactgaaaactttgatcactgtca

SEQ ID NO: 152854 - DNA, 2402 bp, Homo sapiens
  Payload ID: 10065
  Gene Symbol: MARCH7
  Gene Name: membrane-associated ring finger (C3HC4) 7, E3 ubiquitin protein ligase
  Uniprot ID: Q9H992
  ENST ID: ENST00000409175
  CDS Start-End: 261-2375
acttaacggtggtggctggttctgcgccggatccgggagaggggcgggcgccattgtgcttcgctgccgactgcatttcctcagtcacgggcctagaactccaaggagaaaggcggcggaattcatgatttgttcctgtagctgaaacatacattgaatgctttctgccctggcatgaacttacatggtcagagctggtttttcctgccctcaaatatatttctctgactctaccggttagactagaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggactccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccctccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaacttcatataagacagatggatgatctg

SEQ ID NO: 152855 - DNA, 2147 bp, Homo sapiens
  Payload ID: 10065
  Gene Symbol: MARCH7
  Gene Name: membrane-associated ring finger (C3HC4) 7, E3 ubiquitin protein ligase
  Uniprot ID: Q9H992
  ENST ID: ENST00000409591
  CDS Start-End: 80-2080
tttgtaagctgcgcttcacctgctactaatcttgctgttacttctgctatcccatctttaaatttttatcacaatttgaatgattggcaactatgatcatcttatgtctttagtaacatctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggactccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccctccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaacttcatataagacagatggatgatctgtgaacataagtgtttattaaaaatggcaattaaatataaa

SEQ ID NO: 152856 - DNA, 983 bp, Homo sapiens
  Payload ID: 10065
  Gene Symbol: MARCH7
  Gene Name: membrane-associated ring finger (C3HC4) 7, E3 ubiquitin protein ligase
  ENST ID: ENST00000420397
  CDS Start-End: 1-375
gagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgt

SEQ ID NO: 152857 - DNA, 559 bp, Homo sapiens
  Payload ID: 10065
  Gene Symbol: MARCH7
  Gene Name: membrane-associated ring finger (C3HC4) 7, E3 ubiquitin protein ligase
  ENST ID: ENST00000421037
  CDS Start-End: 256-559
gttctgcgccggatccgggagaggggcgggcgccattgtgcttcgctgccgactgcatttcctcagtcacgggcctagaactccaaggagaaaggcggcggtgcgtgttgctgcgagtgggacgcgcactggtcggtgccggctcaggagccgggctttctgccctggcatgaacttacatggtcagagctggtttttcctgccctcaaatatatttctctgactctaccggttagactagaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacct

SEQ ID NO: 152858 - DNA, 3303 bp, Homo sapiens
  Payload ID: 10065
  Gene Symbol: MARCH7
  Gene Name: membrane-associated ring finger (C3HC4) 7, E3 ubiquitin protein ligase
  ENST ID: ENST00000539065
  CDS Start-End: 165-2072
gcgaagtggggggaggaggagcagggaggggcacttaacggtggtggctggttctgcgccggatccgggagaggggcgggcgccattgtgcttcgctgccgactgcatttcctcagtcacgggcctagaactccaaggagaaaggcggcgaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagatgttcaagacagagttccttcatattcacaaggagcaagaccaaaagaaaactcaatgagcactttacagttgaatacatcatccacaaaccaccaattgccttctgaacatcagaccatactaagttctagggactccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccctccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctcattttgataatcatttgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttactgtt

SEQ ID NO: 152859 - DNA, 5272 bp, Homo sapiens
  Payload ID: 10066
  Gene Symbol: MARCH8
  Gene Name: membrane-associated ring finger (C3HC4) 8, E3 ubiquitin protein ligase
  Uniprot ID: Q5T0T0
  ENST ID: ENST00000319836
  CDS Start-End: 751-1626
ctcggtgtcctcccgcggaggggcgtagggtgtaaacaggcgacgcgctgggggaggtgcggccttgctgcgtccacgtctcgggcatgctcgaggcgggccagggcggtagcgccgccagctcagagcccacctgaggtaactcctgcggcctctaggatcggagtcccccacgccgcgcgcagccgccgccgctggccgccaataagggcggccgagcccccggcccgggcagggggtgtggctgccggcagcgcgtcggctacaggtgggctgggctgggctgggctgggctgggctgggtgggggcggccgccaaggacccatccctgcgctgcgggcccggcgtggagcccgcggagaggcagcgcgactccaggcagtgggtctctctgccccggtgctcgcgtctgcccctggggccgggccgagcggaaccaggaatcgcagaaacggtcagcgcccagggctctaggccggccgccccgggtgccaggtgaattcctttccctgaccggctgtgagacgttggcccgtcagccgtcgtctttggcctgagtgtgcacatctgtaaaatggaagctcggactagtgatccgtgaggaccttccacgtctgacgtgtgatctcgagagacctgcgtacattcggggtgccagaaggaaagcatagcttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttcttt

SEQ ID NO: 152860 - DNA, 1848 bp, Homo sapiens
  Payload ID: 10066
  Gene Symbol: MARCH8
  Gene Name: membrane-associated ring finger (C3HC4) 8, E3 ubiquitin protein ligase
  Uniprot ID: Q5T0T0
  ENST ID: ENST00000395769
  CDS Start-End: 240-1115
atggtaggtatagggctgtggatatcgtcagtttgaccaagtattccaagaggccccatggagtttgtcatctgtaatagaggacgttagtgcattagtgatgaaaaaactgcttaccactgactattgtgatctcccagggagtataaggcagctccgcacttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaa

SEQ ID NO: 152861 - DNA, 1456 bp, Homo sapiens
  Payload ID: 10066
  Gene Symbol: MARCH8
  Gene Name: membrane-associated ring finger (C3HC4) 8, E3 ubiquitin protein ligase
  Uniprot ID: Q5T0T0
  ENST ID: ENST00000395771
  CDS Start-End: 1-723
gctgggagtcctccgtcagcatcagctccggctccggtgtcctccttctctcgcacttctatcacgccatccagccaggacatctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaa

SEQ ID NO: 152862 - DNA, 695 bp, Homo sapiens
  Payload ID: 10066
  Gene Symbol: MARCH8
  Gene Name: membrane-associated ring finger (C3HC4) 8, E3 ubiquitin protein ligase
  ENST ID: ENST00000453980
  CDS Start-End: 429-695
cctggggccgggccgagcggaaccaggaatcgcagaaacggtcagcgcccagggctctaggccggccgccccgggtgccaggtgaattcctttccctgaccggctgtgagacgttggcccgtcagccgtcgtctttggcctgagtgtgcacatctgtaaaatggaagctcggactagtgatccgtgaggaccttccacgtctgacgtgtgatctcgagagacctgcgtacattcggggtgccagaaggaaagcatagagatggggtcttgctgtgttgcccagactggtctcaaactcctggcctcaagtgatccttctgcctcagcttcccaaagtactgggattacagcttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcaggatctgccactgtgaaggagatgat

SEQ ID NO: 152863 - DNA, 5638 bp, Homo sapiens
  Payload ID: 10066
  Gene Symbol: MARCH8
  Gene Name: membrane-associated ring finger (C3HC4) 8, E3 ubiquitin protein ligase
  Uniprot ID: Q5T0T0
  ENST ID: ENST00000453424
  CDS Start-End: 263-1984
aagcaccacaggtagcttttggcatggtaggtatagggctgtggatatcgtcagtttgaccaagtattccaagaggccccatggagtttgtcatctgtaatagaggacgttagtgcattagtgatgaaaaaactgcttaccactgactattgtgatctcccagggagtataaggcagctccgcacttgaaatccatggcccaaaatgactctaccagtggagactctcttctgtgaagaagacgaccagataagaggttgggatgagcatgccactgcatcagatctctgccattccatcccaggatgccatctctgctagagtctacagaagtaagaccaaagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgcagttccagtgcagtgttttctgagtgttgtcaccacagttccgtgcagtctgctgttgtctcgaaagctcctcactgccagagttctctgacacaagggctcactgtgacagttatctgtaaggacacattacaggcgtcaaagagaaattcctttggttcagaatgggcccaggccttgaagcctgctaagaataccaaagccagaagaacactaaagttctcaaggtccctcaatgatgtgggtgagaaggcgcaggatacttcagaaagttttgcctatgtggaaagaacttgttctgaagggaaattaatactccctcaagatacgtgtctcagaactaacaggtttcatcataaagaaaaaagaaccctgaaccacaaacctcttggcaattccaaacattcttgtgtttcatgcctttctgccggtcgctcaactgcctcagaggtggaagctggcaaggggggcaggcccggcctgctgctggaagagaaggcggatggtgaggccacgtcccgaagccggcaactgctccagtacctgttctcactctcgcacggcttgagcgccagcagcctgcacaggttccatgagctggagagctgcgctgctcgcctgcacactgccaagtcctccagcgggctggcagggagtatgggcttctgctctgacgagatgggagacgacgatgtctttgaggacagcacatctgcaaaactgaagagtagggttctgcgggcgcccctctgctccacggaaaaggacagcgacctggattgtccttctcccttctctgaaaaattaccccccatatctcccgtgtccacgtcaggggatgtctgcaggatctgccactgtgaaggagatgatgagagccccctgatcaccccctgccactgcacaggaagcctccacttcgtgcaccaggcctgcctgcagcagtggatcaagagctccgacacgcgctgctgcgagctctgcaagtatgagttcatcatggagaccaagctgaagccactgagaaaatgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagttttccaggcaaatagttacctccgggaaagttgctgggggggcctgaagcacaatgtagcgcagatgcttcctttccaggccattctctcacccagcctgcacggaggagatgggagatgctgggggtcctgccctcagtctttttgggccttaggcgtttcgttcatcctgctaaggggatgaagcaaacacgaggtgattcctttgcctttcagagtggaagccctggagtttgttttgaaggccaggaggctgaaggatctctaagctacggtgtgggcttaatagcagcaggctttgtcctcctgtctcctccaagccagtgtctgattccttggcaacacaggtcttagtctgtggagtggctctgctgtggccttcctctggccgggcaggcactgtccagccatagccagctcctgagaataggtcagcctctcctttctgtctcccagggcacatccagcccgtgcctgtgttcactgtgccccgaagtgcaattacccataccccttctcagcctggggaccccaggcaaccacagactgtccactcaggggagctgaatcccaggtcagccctgccaatgtcccttaggaactgcccaggcaaggcccctggttttgtatacttgttcctgccacccagcagtagatgagtgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctttaaaaagga

SEQ ID NO: 152864 - DNA, 114 bp, Homo sapiens
  Payload ID: 10066
  Gene Symbol: MARCH8
  Gene Name: membrane-associated ring finger (C3HC4) 8, E3 ubiquitin protein ligase
  ENST ID: ENST00000612386
  CDS Start-End: 1-114
gctgggagtcctccgtcagcatcagctccggctccggtgtcctccttctctcgcacttctatcacgccatccagccaggacatctgcaggatctgccactgtgaaggagatgat

SEQ ID NO: 152865 - DNA, 2982 bp, Homo sapiens
  Payload ID: 10067
  Gene Symbol: MARCH9
  Gene Name: membrane-associated ring finger (C3HC4) 9
  Uniprot ID: Q86YJ5
  ENST ID: ENST00000266643
  CDS Start-End: 432-1472
gaaggagccgccatttgccaccgccgagcgcacgggccgagccaagcctgatcccggagccggagggggactgggaccgagagaacggcgatggggggcggccccgccgcaggaggacccgggcgcgtaaccccgggggcccggcccgctccagacccagacccgcggggtgcggcaccctgagcccccctccccgccccctgccctggccatggccgcccaccccgccgcccccgggccgccagcccgctcggccccgcaagcaccggagccccggcggtggcagcagtgaacggctgtcgcaggccccgaagaccccggcccggctcggctctctagcgcgcgcccccttcccggccttgtcctctcccctccccccgccgctagcgagccccccttgcacgctgccccccgcccccggtgtccggacgatgctcaagtctcggctccgcatgtttctgaacgagctgaagctgctggtgctgacaggcggggggcggccccgggccgagccgcaaccccgggggggccggggaggcggctgcggctgggcgcccttcgctggctgctccacccgggacggcgacggcgacgaggaggagtactacgggtcggagccgcgggcccggggcctggccggcgacaaggagccgcgggccggacccctgccgccgcccgcgccgccgctgccgcccccgggcgcgctggacgccctgtcgctcagcagtagcctggacagcggactccgaacccctcagtgccggatctgcttccagggcccggagcagggggagctcttaagcccctgccgctgcgacggctcagtgcgctgcacgcatcagccctgcctcatccgctggatcagcgagaggggctcctggagctgtgagctctgctacttcaagtaccaggtcctggcgatcagcaccaagaacccactgcagtggcaggccatctccctgacggtcatcgagaaggtccagattgctgccatagttctgggctcgctcttcctggttgccagcatctcctggctcatctggtcctcactcagcccttcagccaagtggcaacgacaggatctgctctttcagatctgctacggcatgtatggcttcatggatgtcgtctgcataggcctcatcatccatgaaggctcctctgtctaccgcatcttcaagcgctggcaggcagtgaaccagcagtggaaggtcctaaattatgacaagaccaaggacataggaggagatgcagggggagggacggcagggaagtcaggccccaggaactcacggacgggccccacctctggggccacgagccgccccccagctgcccagcgcatgcggacgctcttgcctcagcgctgcggttatacaatcttgcacctccttgggcagctgcggccaccagatgcccgttccagctcccattctggccgagaggttgtcatgagggtcactacagtctgaactggactccaggagcagggatcttgagtcaatgcatcagtcagagaagaactctcatggctgctggaggtaccagctggacaaggtgtttggggcatgctgcccccgtcaccgaggatctgtgtgggtagcctcaagctggagacattgtctggcctcactgcccactgggtagagacacctggatgacatttcagtacccgctggcagctcctcccactcatccagagacggccggtgggcaggcggggagagcagctttccttccctggagagaaccgtctttacctcagctcctagggcctccagccccccagctccaccacggtgacttggtgaagggggaccaatgccagaagaaaggggctgtagacccctattccccaccccatggccacagggcatctggcaataagactagtatacattgacctcccgttccctgcatgagggcggggagttccccctgctccatcccccattgcatgggggaagggcataaagaatcatttatatgcacgtggagactcctttctcatctggggcttttctggagggttgggagatgtggggaggtttctctgcacaggttgcaaatcccaaatgcagcagtgggttctgagttgtaggtgtgactcccacttgctggtgaataattcatgttggctgctaggtggcagcactccgaggtatctaaagggtagacctggacctgccacctatgagttgtgtgatatagaaaaaaatctcttagctctggttttcctgtctacttcatagggttggaataaggataaatgagggacaggttggatgccgttgcagagaaaatcagcaatgacataaagagatttctagaatagttgatggtccatttatttcaaatagtagctggtgtaacaaattctaaaatgtgtttttcatctggagttgcacagaatcatggaattttgtgttgagtgacataataggtatggaaatatgaggggaaatagacattgcaaatgtgaagcatggtggttatttgttaagaatgagaactcctctgactctaaatatttgggcctgtgggctggggaaggctggagccatctgccttgttctggagatcatctgggttctatcagtccttctcaagtactgtgctcacccagaaaagcagtgtgaagtgaatttggactcatttggagtgagatggagggaatccccccactcagtgttatgagtctccaaccccagtttaagctatttccatggcagtttagggtcacaggtttgatcccggtgtgcccagccagtggtattaatggatggcattatgtttggaggcagcagcatagaggactgttgtttatagagaaaagatttgggaaggactgtttacaatgtgggtcagcctgaagcctgggcactttcttctgtgaccttggggttgtgtattatatgaatgatgctgtttttaagtaaaccattcaacagcaattaaataattccttcattcacggctaaa

SEQ ID NO: 152866 - DNA, 1668 bp, Homo sapiens
  Payload ID: 10067
  Gene Symbol: MARCH9
  Gene Name: membrane-associated ring finger (C3HC4) 9
  Uniprot ID: Q86YJ5
  ENST ID: ENST00000548358
  CDS Start-End: 448-1149
actaagaatacaaaaattagccaggcgtggtggctcgtgcctgtaagctactcgcgaagctgaggcgggagaatccttgaacccgggaggcagaggttgcagtgagccgagatcacagccactgcactccagcctgggcaacagagcaagactccgtctcgaaggaaaaaaaaaaaaaagaaaagaaaaaatgatgttgatgatgatagcaaatatgtagtgttttctgtgtcaagttttggtgtgtattaactcttaatcttcacaataatcttattagatactattattatccccttttacaaacgaggacactgatgcacaaagatttgaaaacttacccaaggttacttagccagtaagtgatggagtcaagatttaggattcaaatctagatgttttggtttcagagcacttgcccaatcctgcctttctaaagtaagacaaatggtgtcagacaagtgccacattctagatttaatcaaggcacagagaagacagatgttgatcctgcctgaaggttttagggaaggttcctggagcaccctgctcttcagggccacccatcacctggccctccatccctttctgggactctttggagccctttctcccacacagtggcaggccatctccctgacggtcatcgagaaggtccagattgctgccatagttctgggctcgctcttcctggttgccagcatctcctggctcatctggtcctcactcagcccttcagccaagtggcaacgacaggatctgctctttcagatctgctacggcatgtatggcttcatggatgtcgtctgcataggcctcatcatccatgaaggctcctctgtctaccgcatcttcaagcgctggcaggcagtgaaccagcagtggaaggtcctaaattatgacaagaccaaggacataggaggagatgcagggggagggacggcagggaagtcaggccccaggaactcacggacgggccccacctctggggccacgagccgccccccagctgcccagcgcatgcggacgctcttgcctcagcgctgcggttatacaatcttgcacctccttgggcagctgcggccaccagatgcccgttccagctcccattctggccgagaggttgtcatgagggtcactacagtctgaactggactccaggagcagggatcttgagtcaatgcatcagtcagagaagaactctcatggctgctggaggtaccagctggacaaggtgtttggggcatgctgcccccgtcaccgaggatctgtgtgggtagcctcaagctggagacattgtctggcctcactgcccactgggtagagacacctggatgacatttcagtacccgctggcagctcctcccactcatccagagacggccggtgggcaggcggggagagcagctttccttccctggagagaaccgtctttacctcagctcctagggcctccagccccccagctccaccacggtgacttggtgaagggggaccaatgccagaagaaaggggctgtagacccctattccccaccccatggccacagggcatctggcaataagactagtatacattgacctcccgttccctgcatgagggcggggagttccccctgctccatcccccattgcatgggggaagggcataaagaatcatttatatgca

SEQ ID NO: 152867 - DNA, 4338 bp, Homo sapiens
  Payload ID: 10068
  Gene Symbol: MBTPS1
  Gene Name: membrane-bound transcription factor peptidase, site 1
  Uniprot ID: Q14703
  ENST ID: ENST00000343411
  CDS Start-End: 497-3655
cagggcacgctgggtcggcggagctgaggctcccagctgtgggcctcgctggcccggtcgcccagtctcgcgagagttgggagtaaacagccccgaatggagtgcccaggcgtgttcgccgcggaggcgccgttatcccgggcccgccggccctgagctcccggcggcgcagattggctcacagtggttgattgatcaaccccattggacgttggttctgtggtacaaatggagtacaggactcagtcgtcacggcctgagtgagagaagccttatttccaagatggagaagaagcggagaaagaaatgaaagcctctcttcaggctgaaccacaaaaggccatgggatttaacttttatttatgttgggcaagactgtaagatggctgattagtaatgttgcagcttttagctgaaacaaaaattcacttttaatcaagaagaaaaaagtgtgatttgaatatatgcaattttatgatcatattcgcttgtgaccatgaagcttgtcaacatctggctgcttctgctcgtggttttgctctgtgggaagaaacatctgggcgacagactggaaaagaaatcttttgaaaaggccccatgccctggctgttcccacctgactttgaaggtggaattctcatcaacagttgtggaatatgaatatattgtggctttcaatggatactttacagccaaagctagaaattcatttatttcaagtgccctgaagagcagtgaagtagacaattggagaattatacctcgaaacaatccatccagtgactaccctagtgattttgaggtgattcagataaaagaaaaacagaaagcggggctgctaacacttgaagatcatccaaacatcaaacgggtcacgccccaacgaaaagtctttcgttccctcaagtatgctgaatctgaccccacagtaccctgcaatgaaacccggtggagccagaagtggcaatcatcacgtcccctgcgaagagccagcctctccctgggctctggcttctggcatgctacgggaaggcattcgagcagacggctgctgagagccatcccgcgccaggttgcccagacactgcaggcagatgtgctctggcagatgggatatacaggtgctaatgtaagagttgctgtttttgacactgggctgagcgagaagcatccccacttcaaaaatgtgaaggagagaaccaactggaccaacgagcgaacgctggacgatgggttgggccatggcacattcgtggcaggtgtgatagccagcatgagggagtgccaaggatttgctccagatgcagaacttcacattttcagggtctttaccaataatcaggtatcttacacatcttggtttttggacgccttcaactatgccattttaaagaagatcgacgtgttaaacctcagcatcggcggcccggacttcatggatcatccgtttgttgacaaggtgtgggaattaacagctaacaatgtaatcatggtttctgctattggcaatgacggacctctttatggcactctgaataaccctgctgatcaaatggatgtgattggagtaggcggcattgactttgaagataacatcgcccgcttttcttcaaggggaatgactacctgggagctaccaggaggctacggtcgcatgaaacctgacattgtcacctatggtgctggcgtgcggggttctggcgtgaaaggggggtgccgggccctctcagggaccagtgttgcttctccagtggttgcaggtgctgtcaccttgttagtgagcacagtccagaagcgtgagctggtgaatcccgccagtatgaagcaggccctgatcgcgtcagcccggaggctccccggggtcaacatgtttgagcaaggccacggcaagctcgatctgctcagagcctatcagatcctcaacagctacaagccacaggcaagtttgagccccagctacatagatctgactgagtgtccctacatgtggccctactgctcccagcccatctactatggaggaatgccgacagttgttaatgtcaccatcctcaacggcatgggagtcacaggaagaattgtagataagcctgactggcagccctatttgccacagaacggagacaacattgaagttgccttctcctactcctcggtcttatggccttggtcgggctacctggccatctccatttctgtgaccaagaaagcggcttcctgggaaggcattgctcagggccatgtcatgatcactgtggcttccccagcagagacagagtcaaaaaatggtgcagaacagacttcaacagtaaagctccccattaaggtgaagataattcctactcccccgcgaagcaagagagttctctgggatcagtaccacaacctccgctatccacctggctatttccccagggataatttaaggatgaagaatgaccctttagactggaatggtgatcacatccacaccaatttcagggatatgtaccagcatctgagaagcatgggctactttgtagaggtcctcggggcccccttcacgtgttttgatgccagtcagtatggcactttgctgatggtggacagtgaggaggagtacttccctgaagagatcgccaagctccggagggacgtggacaacggcctctcgctcgtcatcttcagtgactggtacaacacttctgttatgagaaaagtgaagttttatgatgaaaacacaaggcagtggtggatgccggataccggaggagctaacatcccagctctgaatgagctgctgtctgtgtggaacatggggttcagcgatggcctgtatgaaggggagttcaccctggccaaccatgacatgtattatgcgtcagggtgcagcatcgcgaagtttccagaagatggcgtcgtgataacacagactttcaaggaccaaggattggaggttttaaagcaggaaacagcagttgttgaaaacgtccccattttgggactttatcagattccagctgagggtggaggccggattgtactgtatggggactccaattgcttggatgacagtcaccgacagaaggactgcttttggcttctggatgccctcctccagtacacatcgtatggggtgacaccgcctagcctcagtcactctgggaaccgccagcgccctcccagtggagcaggctcagtcactccagagaggatggaaggaaaccatcttcatcggtactccaaggttctggaggcccatttgggagacccaaaacctcggcctctaccagcctgtccacgcttgtcttgggccaagccacagcctttaaacgagacggcgcccagtaacctttggaaacatcagaagctactctccattgacctggacaaggtggtgttacccaactttcgatcgaatcgccctcaagtgaggcccttgtcccctggagagagcggcgcctgggacattcctggagggatcatgcctggccgctacaaccaggaggtgggccagaccattcctgtctttgccttcctgggagccatggtggtcctggccttctttgtggtacaaatcaacaaggccaagagcaggccgaagcggaggaagcccagggtgaagcgcccgcagctcatgcagcaggttcacccgccaaagaccccttcggtgtgaccggcagcctggctgaccgtgagggccagagagagccttcacggacggcgctggtgggtgagccgagctgtggtggcggctggtttaaaagggatccagtttccagctgcaggtttgttagagtctgttctacatgggcctgccctcctgtgatgggcagaggctcctggtacatcgagaagattcctgtggatcccgtcaggagggacttagtggctctgccgccagtgagacttcccgccggcagctgtgcgcaccaaagactcgggagaactggaaaggctgtctggggtcttctgactgcaggggaaggatgtactttccaaacaaatgatacaaccctgaccaagctaaaagacgcttgttaaaggctattttctatatttattgttgggaaaagtcactttaaagacttgtgctatttggaagcaaagctattttttttgtcagtggaatgcagtttttttactattccatcatgaggaacaacatagattccatgatctttttaatgacagtacagactgagatttgaaggaaacatgcacaaatctgtaaaacatagaccttcgctttatttttgtaagtatcacctgccaccatgttttgtaatttgaggtcttgatttcaccattgtcggtgaagaaaattttcaataaatatgtattacccgtctgaagctt

SEQ ID NO: 152868 - DNA, 587 bp, Homo sapiens
  Payload ID: 10068
  Gene Symbol: MBTPS1
  Gene Name: membrane-bound transcription factor peptidase, site 1
  ENST ID: ENST00000569907
  CDS Start-End: 539-587
gagagttgggagtaaacagccccgaatggagtgcccaggcgtgttcgccgcggaggcgccgttatcccgggcccgccggccctgagctcccggcggcgcaggggagattttaggaaagcaggcgacctgcctctgaagagtgtggcctctggagccaggctgaccacctgagttctcagcccagctgttctacttgctggtgttgtggccccagattggctcacagtggttgattgatcaaccccattggacgttggttctgtggtacaaatggagtacaggactcagtcgtcacggcctgagtgagagaagccttatttccaagatggagaagaagcggagaaagaaatgaaagcctctcttcaggctgaaccacaaaaggccatgggatttaacttttatttatgttgggcaagactgtaagatggctgattagtaatgttgcagcttttagctgaaacaaaaattcacttttaatcaagaagaaaaaagtgtgatttgaatatatgcaattttatgatcatattcgcttgtgaccatgaagcttgtcaacatctggctgcttctgctcgtggttttgctctgtg

SEQ ID NO: 152869 - DNA, 546 bp, Homo sapiens
  Payload ID: 10068
  Gene Symbol: MBTPS1
  Gene Name: membrane-bound transcription factor peptidase, site 1
  ENST ID: ENST00000563231
  CDS Start-End: 1-244
gttaaacctcagcatcggcggcccggacttcatggatcatccgtttgttgacaaggtgtgggaattaacagctaacaatgtaatcatggtttctgctattggcaatgacggacctctttatggcactctgaataaccctgctgatcaaatggatgtgattggagtaggcggcattgactttgaagataacatcgcccgcttttcttcaaggggaatgactacctggcacagtccagaagcgtgagctggtgaatcccgccagtatgaagcaggccctgatcgcgtcagcccggaggctccccggggtcaacatgtttgagcaaggccacggcaagctcgatctgctcagagcctatcagatcctcaacagctacaagccacaggcaagtttgagccccagctacatagatctgactgagtgtccctacatgtggccctactgctcccagcccatctactatggaggaatgccgacagttgttaatgtcaccatcctcaacggcatgggagtcacaggaagaattgtagataagcctgactggcagc

SEQ ID NO: 152870 - DNA, 582 bp, Homo sapiens
  Payload ID: 10068
  Gene Symbol: MBTPS1
  Gene Name: membrane-bound transcription factor peptidase, site 1
  ENST ID: ENST00000570012
  CDS Start-End: 145-582
gtgttcgccgcggaggcgccgttatcccgggcccgccggccctgagctcccggcggcgcagattggctcacagtggttgattgatcaaccccattggacgttgggttgggccatggcacattcgtggcaggtgtgatagccagcatgagggagtgccaaggatttgctccagatgcagaacttcacattttcagggtctttaccaataatcaggtatcttacacatcttggtttttggacgccttcaactatgccattttaaagaagatcgacgtgttaaacctcagcatcggcggcccggacttcatggatcatccgtttgttgacaaggtgtgggaattaacagctaacaatgtaatcatggtttctgctattggcaatgacggacctctttatggcactctgaataaccctgctgatcaaatggatgtgattggagtaggcggcattgactttgaagataacatcgcccgcttttcttcaaggggaatgactacctgggagctaccaggaggctacggtcgcatgaaacctgacattgtcacctatggtgctggcgtgcggggttctggcgtgaaaggg

SEQ ID NO: 152871 - DNA, 431 bp, Homo sapiens
  Payload ID: 10068
  Gene Symbol: MBTPS1
  Gene Name: membrane-bound transcription factor peptidase, site 1
  ENST ID: ENST00000562788
  CDS Start-End: 1-405
gttgcttctccagtggttgcaggtgctgtcaccttgttagtgagcacagtccagaagcgtgagctggtgaatcccgccagtatgaagcaggccctgatcgcgtcagcccggaggctccccggggtcaacatgtttgagcaaggccacggcaagctcgatctgctcagagcctatcagatcctcaacagctacaagccacaggcaaggtcagtgcaccgccctgccgatgggtctttctctccttcactgggctctgggcgaattttccctctgcacaaaatacaagcctcaaaacagaaaatgatgactaagcacagaattctcggggtgcttggagaggttttgctgctgcttctacagggtgctgctggcagaactggtagctgctttcgcttactgatgtgatctttaatataaatggttaaaagtaa

SEQ ID NO: 152872 - DNA, 4457 bp, Homo sapiens
  Payload ID: 10069
  Gene Symbol: MBTPS2
  Gene Name: membrane-bound transcription factor peptidase, site 2
  ENST ID: ENST00000365779
  CDS Start-End: 82-1074
aaggcgcgcgcggtcagctgttggcggtgcagggaggaggacgccggggctcgccttccctcctctgccgccgctgccgccatgattccggtgtcgctggtggtggtggtggtgggtggctggactgtcgtctacctgaccgacttggtgctgaagtcatctgtctattttaaacattcttatgaagactggctggaaaacaacggactgagcatctcccctttccacataagatggcaaactgctgttttcaatcgtgccttttacagttggggacggcggaaagcaaggatgctttaccaatggttcaattttggaatggtgtttggcgtaattgccatgtttagctcattttttctccttggaaaaacgctgatgcagactttggcacaaatgatggctgactctccctcttcttattcttcctcctcttcttcctcttcctcctcttcttcctcttcctcttcttcatcttcttcctcttcctcgcttcacaatgaacaggtgttacaagttgtggttcctggtataaatttacccgtcaatcaactgacctatttcttcacggcagttctcattagtggtgttgtacatgaaattggacatgggatagcagctattagggaacaagttcgatttaatggctttgggatttttctcttcattatttatcctggagcatttgttgatctgttcaccactcatttgcaacttatatcgccagtccagcagctaaggatattttgtgcaggtatctggcataattttgtccttgcactcttgggtattttagctcttgttctcctcccagtaattctcttgccattttactacactggagttggggtgctcatcactgaagttgctgaggactctcctgccattggacccagaggcctttttgtgggagaccttgtcacccatctacaggattgtcctgttactaatgtgcaagattggaatgaatgtttagataccatcgcctatgagccccaaattggttactgtataagtgcatcaactttacagcagttaagtttcccagttagaggtgtgtatatttcctcaatataatataatgcttcaagcaccagtacctgccattcactaatccttaaaccatgtctatacatttattctgttctaatctgtttaaagcaaatcagtaaagtaaatagattccaaccaatagacatttttcttggtaagttggatgctaatatgtgtttcctttattatatattgttgaacttctaactattttcattatatcatatttaacttttaggactctaatattttctgctttcaaaacacttgtattaaatcatagccgggcgcagtggctcacgcctgtaatcccagcactttgggaggctgaggcgggcggatcacttgaggtcaggagttcatgaccaacctggccaacatagtgaaaccccatctctactaaaaatacaaaaattagcagggcatggtgacgggtgcctgtgatttcagctgctcgggagtctgaggcaggagaatcgcttgaacccgggaggtggaggttgcaatgagccgagatcgggacatggaaagagactctgtctcaaaaaaaaaaaaaaaaatcagcattcaaggtcaatcataaccaattaactaattccaataatcaaataccccaatataatattatctttatgcatgtctgtagatatattatagtactttaaacttttataattgaaaaagggaatataagtaataagaaccggttctactttgcataagcttatgtcagaacagataaacaacgatagttaacaactaaatatataaaaatcaaagcataaacattctgtattaatatattgttagcccaacacagacatgcaataaggaaagattacaagaaataagaaggaacttggcaaacaaaaaaccccatctgggatttagaaaaaattcccttacttcttaaaaattcccttaatacttaaacagttctagtggaatcagtgttggcatgtctgattctatctggggtagagttattttatgtattttatgtggcagccatcctaaagaagttgtcttggcttccaaaaataccatgtgaagtcagatatgttgctctgtgcagcagatgacagagctgaggcaagtttcttctcggatcctgccaaacttatttagagttatttcagctctgaaaaatcagcttcccaattctttatacaaaatcagcttcccaattctttatacaaaattggaggtgttagaaaatagaaattatgctcacagactatatctttaagtaaaaaaatatcctgatacttgtccacatctattggtgtagggaaatatgattaataatcaagaatagttttagtaaagtactgtgtgcaacacaggcaaagtagtaagaactgatttttttaaaaaaactttttaaaatttactcatttgtaagaatttttttattatcaaaaatgtttagacacgatggagaatatatttcctcaatataatataatgcttcaagcaccagtacctgccattcactaatccttagaccatgtctatagatttattctgttctaatctgtttaaagtaaatcagtaaagtaaatagattcaaaccaatagacatttttcttggtaagttggatgctaatatgtgtgtttcctttattatatattgttgaacttctaactattttcataatatcatatttaacttttaggactctaatattttctagtataaacgagcccacatgtatctttctgccagcttcggcagttattaacattttgccaattttttcatctaagcagtccacttttaggggaagtattttaaagtacatcccaggcatcctatcatttcatccataacctttcagcctgcctttaacggatgatgactcattaaacacgaccacaatactgttataattcctaacaaaataacactaatttctgatatctggttggtattcagttgtttctaattcttttcattatagttgatttaaattagttaggatgtcttctaagactttttaaatttgtaacaattttccttgacctgtttttgaaatgttatttttttgttgaagaaactgaggcatttgttttgttgaatttcctaaattctgggtttttctggttatatcttatcctcatgatgtcattaacttgttcagatgtcttccaattttctataaactgctaattaggtccatggcgttgattagattcagaatcctttttttttgtttgggttttttttttggcaaaaacacttcataaacagcgcttggtacttcctgtggcatcatattgcatccagtatctattgttctctgttttaatggtgttaagattgttcagtggagcaatctgattctttaaggttgaaatatttataaattttccccattctcaggagcctcttaccatcttccaaaacttttaagatgacagaagattaatatgtaatccacaatgtgttcttctttaaagaaatgatccattattttccacttcttaagtcctttatccttttcttttggtttctctaaatttgatgtaatgtgtattgaattacaaaaaccaaagtgacacactagttaaataaagttctcttcagtaggattgttttacttaggatatctgcattttcagatgtttagggttttatccttttcctgacagacagactgtaaataaaaattttccctgaaacactcagaaactctcttcttattaactgtttgagtatttcactgttgtggatcatgtgctacattttggaggtatttgtttaaatacctaaagcagatattactctttttatactacaatcaatccagaagtaattcttttttttttttttcaagccctgggctgtcccagcccaagagtaattcttcaatatctattttgtctcagtatacatgtttattttacatgattactatatctgataaatctgtgcctctatttaagcttttgaaaatggagtatgtatacttagccagtttaaaggagtattaatgtctgtaaatatcacttaaaatacatactatggctggtccaaatgcagttgtgcttacaattaattgaacacaaccagttacagaattctttgttccttctctattcccactacatcacttgactagccttaaaaaaaaaatacatactagattaattttgatggcaggcttagcccctgggtctgtggacatttaagaaagctatggattgatggtattttatatgtttctaggtaacttcgttatccttcattgtaagtaggagtgaaagatatggtcagatatactattacagagtgtccaatgatccaaaagttattcatgttcaatttagagtagaattcagtacacataactaaattctaggaatttataccatttcagagcaataaagccacctaggaaaga

SEQ ID NO: 152873 - DNA, 4428 bp, Homo sapiens
  Payload ID: 10069
  Gene Symbol: MBTPS2
  Gene Name: membrane-bound transcription factor peptidase, site 2
  Uniprot ID: O43462
  ENST ID: ENST00000379484
  CDS Start-End: 100-1659
agcggatgctggggctgtaaggcgcgcgcggtcagctgttggcggtgcagggaggaggacgccggggctcgccttccctcctctgccgccgctgccgccatgattccggtgtcgctggtggtggtggtggtgggtggctggactgtcgtctacctgaccgacttggtgctgaagtcatctgtctattttaaacattcttatgaagactggctggaaaacaacggactgagcatctcccctttccacataagatggcaaactgctgttttcaatcgtgccttttacagttggggacggcggaaagcaaggatgctttaccaatggttcaattttggaatggtgtttggcgtaattgccatgtttagctcattttttctccttggaaaaacgctgatgcagactttggcacaaatgatggctgactctccctcttcttattcttcctcctcttcttcctcttcctcctcttcttcctcttcctcttcttcatcttcttcctcttcctcgcttcacaatgaacaggtgttacaagttgtggttcctggtataaatttacccgtcaatcaactgacctatttcttcacggcagttctcattagtggtgttgtacatgaaattggacatgggatagcagctattagggaacaagttcgatttaatggctttgggatttttctcttcattatttatcctggagcatttgttgatctgttcaccactcatttgcaacttatatcgccagtccagcagctaaggatattttgtgcaggtatctggcataattttgtccttgcactcttgggtattttagctcttgttctcctcccagtaattctcttgccattttactacactggagttggggtgctcatcactgaagttgctgaggactctcctgccattggacccagaggcctttttgtgggagaccttgtcacccatctacaggattgtcctgttactaatgtgcaagattggaatgaatgtttagataccatcgcctatgagccccaaattggttactgtataagtgcatcaactttacagcagttaagtttcccagttagagcatacaaacgactagatggttcaactgaatgctgtaacaatcacagcctcacagatgtgtgcttttcctacagaaataattttaataagcgtttgcatacatgtcttcctgcccggaaagcagttgaagcaactcaagtttgcagaaccaataaagactgtaaaaaaagctcaagttcaagtttctgtataataccttctttggaaactcacactcgcttaataaaagtaaaacacccacctcagattgatatgttatacgtaggacatcctctgcatcttcactacacagtgagcatcaccagttttatcccacgttttaactttctaagcatagatctgccagtggttgtggagacatttgtcaagtacctgatttccctctcaggagctctggctattgttaatgcagtaccctgctttgctttggatggacaatggattctaaactctttcttggatgccacccttacctcagtgattggagacaatgatgtcaaagatctaatagggtttttcatcttgctgggtggcagtgtacttttggctgccaatgtgaccctgggactctggatggttacagcacggtaatgtttgcactcatctgacagaatccctgagttacagtatacagctatgtggtaatattcattgccattgaaattcttacttggtatgaaatataaagtgtttccttaaaattacatcttagccaacaaccctgagctcctcccatatccagagtacccaaactctgtggtagaagataagcagaagaaatgaaaggcatagtccctgactatattctaatttaggactgaatgtacccagatgcttgtggaataatatctaagcaagtgcaaattcatgtaataccgttttgtctgattacatattgtgttgaaatagtataaaggagaacagaactgggtggaattaattgggaaaaacttcttacaaaagcatcattaatcaaaatttgaaggagaccagactttggccaagtggaaggatgaccattgtcttggcctgtatctcttgtcctttgtcttgtttgaaaagtattttaaaacttaatggtgtattattttgtgctctgaaagctgaggtctgattacaattagtaaaattctatagaagaatctgctgacgtgaaagggaaaaatctttgtcaaatgataccaaataaatgaacaaaacaggaagtagggcctatgatatcgtgagacatgttttgccccacaagagttgcatcttttataaggtgtctctgccccctcataaagcagcactagctttgacatccacggtgagctgcaggaagcatcacacaccagcagcatgtgagcagagggaggcagttggggttgaacttcggaactaggccgggtctcctgacagatcacaagacaccccagaggatcttcagcagtcctacttcccattctctatagagctttgaagcttggaacccttccagggtaaacattttctcttgtgctgctcaggacatctggggcctagctcctgggttcctgtctccaagaagcaatgaccttaaactctgagccatactctgtcctcaccagcggctcccatgtttttctgtgtcaggttattaagtacctagtccttgttttctgtctctctcctaagctacctctctgggtccacagaagacttggtagtatagtgagaatggctatacgtgagtacaaacgtggattttccagggcttgggaactgattcttgagcccagaagagccacgcctgctttgaggtcttttggagtggagatgcagccctgggaaatttggggagtcagcaggccagtgtgaagctattggtcctaggagtatatgagcttgctgtttctttgatggaaaatacatgcttctcttgtatactcagaagtgactaagggcaataactcattaatagccatctatccaacttctttactgagtgatgtattccatggggttacctttttcagattattgagttgctctgtaagcactaaaactttttaatcatttttaagaaactttttagattgtattacaaatttgccttaacagtaattagatgttgaatataattttaacattttattaatgacttgggtcatcagttaataccagtactaaaaccatacgaattattggtttattccagaaaatacagtatttgttctatttttaggtagacaatcatttgggatcagagtacattagcatagtaatgctcagtcagacctgttcaagtagtagagcttggagaatgccatgaaatacttatataattaatttgattgcatgaactaagcaattttactaatgaaaaggttgtatatgtgcaagtcacttttttaaaaaccaagaaaaaactttaatagaggaaatcttattcattaatttatttttctgagtaaaaaaacgaaacccaaatctcattttatttcaactgttaaacattttgatctgttgacccataggatcaggatttgggaaccactttactaggaaagagcagatcagtaccatttgtataaaaccggcctcattatgtaagaaagaaaatgttacgtgttttcttctttagcttggttgtgggcacttctacagcaaggaccatatcatattcatctttgcatccctggcacagtgcatgagacataagtacttaataaatgcagttgaatggataatgattagtgttatttatggattagaaaaagcatgtttctatttaagtaagctgtaaaaagtattattgaatatttactgtaaatatatgttcacataaaaaaataacttggagggtctttgtgtccctggcatattatcatcttcatggaaagaatccactgtggtttctgtagagtgattggaaaaatggattattttgaggattgaagaaagtgttctttctgcgttgtcactttgttcaacagtaaaactttattctcagtgttcctactctgcattgtttacatttttgacagttttttttaatcacctacaatctgtaaagaatgtatatattcttttcagcatctcagtttgaaaagacatgcagttaaacttgaccttttgataatcgctcttacaggtcattgtctgttctaacagcaaattgtaaacatgtgcttcatagatattgtggctctcagtcatcactttgtcctatggtatttattgaatgttcacatactaatggtgcacaggtgtttttttctataaatcttctgactgtcctgtaattcattcttaagctttaacttgaaggtatcgtaattgccggcatttgatgtttagcaataaaagaataaatgtgtaccagcattttatgtttat

SEQ ID NO: 152874 - DNA, 3331 bp, Homo sapiens
  Payload ID: 10070
  Gene Symbol: MS4A1
  Gene Name: membrane-spanning 4-domains, subfamily A, member 1
  Uniprot ID: P11836
  ENST ID: ENST00000345732
  CDS Start-End: 154-1047
gtctatcagcgatttcatcttcaggcctggactacaccactcaccctcccagtgtgcttgagaaacaaactgcacccactgaactccgcagctagcatccaaatcagcccttgagatttgaggccttggagactcaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagatgattccaacatgggtgtttgtctattcttctttactcttgaaacattagaccatgggaggctcttacagccttgagttgatatttatacaacccaaatctaggtttgaacggtgaggtgtcaggtcatcaaatattcatgtctatatagtcttacacaggttctcaaaaaaaatgttcatgggataggtcattgataatggattccttattctgagaactccagacgactgaaatatatgagagaaggaaaaggacatagtaggagcaggcctgagaaaaaaatgaaagtcagaaatctttaaaaaaatacaagatcttatttctatcttattttttctcctcttctgaaatatatatgaggattcctctccaaacccatggtttctctaagaattttgagtcatttgtatgacctcaaataattagttttagctgacctcacataactccttataataggagacatctttaatgtctgctattaaagaaggatgaaaattcctatgaccttctccccgattatccctttggcaatatagagtcaaataataacattgaccaatagtaaacatgctttgccaagaagtagaagatatattctctagccttagtttttcctcccaatttgcatttttgtaaaaataatgttgtatccacaaaggaaataaactttaaaaacccaagtgca

SEQ ID NO: 152875 - DNA, 3372 bp, Homo sapiens
  Payload ID: 10070
  Gene Symbol: MS4A1
  Gene Name: membrane-spanning 4-domains, subfamily A, member 1
  Uniprot ID: P11836
  ENST ID: ENST00000389939
  CDS Start-End: 195-1088
tcagaactcagcagtaggccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagatgattccaacatgggtgtttgtctattcttctttactcttgaaacattagaccatgggaggctcttacagccttgagttgatatttatacaacccaaatctaggtttgaacggtgaggtgtcaggtcatcaaatattcatgtctatatagtcttacacaggttctcaaaaaaaatgttcatgggataggtcattgataatggattccttattctgagaactccagacgactgaaatatatgagagaaggaaaaggacatagtaggagcaggcctgagaaaaaaatgaaagtcagaaatctttaaaaaaatacaagatcttatttctatcttattttttctcctcttctgaaatatatatgaggattcctctccaaacccatggtttctctaagaattttgagtcatttgtatgacctcaaataattagttttagctgacctcacataactccttataataggagacatctttaatgtctgctattaaagaaggatgaaaattcctatgaccttctccccgattatccctttggcaatatagagtcaaataataacattgaccaatagtaaacatgctttgccaagaagtagaagatatattctctagccttagtttttcctcccaatttgcatttttgtaaaaataatgttgtatccacaaaggaaataaactttaaaaacccaagtgca

SEQ ID NO: 152876 - DNA, 558 bp, Homo sapiens
  Payload ID: 10070
  Gene Symbol: MS4A1
  Gene Name: membrane-spanning 4-domains, subfamily A, member 1
  ENST ID: ENST00000532491
  CDS Start-End: 540-558
cactcaccctcccagtgtgcttgagaaacaaactgcacccactgaactccgcagctagcatccaaatcagcccttgagatttgaggccttggagactcagagagaccacaagaggagcaagcaagagagctgggactaactctgtctgctacatattgccagaaattgggagactgaaggtgcaaagaagaaataatttcttggaagggctaacagcttggttggactgagatgggctgaaaagcacagagggaagggaaatcctgaacaagagagaacaaaatctctactttgatggaacttccattctgtggggaagagactgacaataagcaattaaataaataagaactcagcagtaggccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaatt

SEQ ID NO: 152877 - DNA, 928 bp, Homo sapiens
  Payload ID: 10070
  Gene Symbol: MS4A1
  Gene Name: membrane-spanning 4-domains, subfamily A, member 1
  Uniprot ID: P11836
  ENST ID: ENST00000528313
  CDS Start-End: 112-504
accctcccagtgtgcttgagaaacaaactgcacccactgaactccgcagctagcatccaaatcagcccttgagatttgaggccttggagactcaggagttttgagagcaaaatgacaacacccagaaattcagtaaatgggactttcccggcagagccaatgaaaggccctattgctatgcaatctggtccaaaaccactcttcaggaggatgtcttcactggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttgg

SEQ ID NO: 152878 - DNA, 495 bp, Homo sapiens
  Payload ID: 10070
  Gene Symbol: MS4A1
  Gene Name: membrane-spanning 4-domains, subfamily A, member 1
  ENST ID: ENST00000524807
  CDS Start-End: 474-495
aaagtaattggagcgaagcccaaggtagcagaagctactgatttcctgtcacctgatgtctatcagcgatttcatcttcaggcctggactacaccactcaccctcccagtgtgcttgagaaacaaactgcacccactgaactccgcagctagcatccaaatcagcccttgagatttgaggccttggagactcagatcctgaacaagagagaacaaaatctctactttgatggaacttccattctgtggggaagagactgacaataagcaattaaataaataagaactcagcagtaggccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcag

SEQ ID NO: 152879 - DNA, 3475 bp, Homo sapiens
  Payload ID: 10070
  Gene Symbol: MS4A1
  Gene Name: membrane-spanning 4-domains, subfamily A, member 1
  Uniprot ID: P11836
  ENST ID: ENST00000534668
  CDS Start-End: 290-1183
actcaccctcccagtgtgcttgagaaacaaactgcacccactgaactccgcagctagcatccaaatcagcccttgagatttgaggccttggagactcagaactcagcagtaggccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagatgattccaacatgggtgtttgtctattcttctttactcttgaaacattagaccatgggaggctcttacagccttgagttgatatttatacaacccaaatctaggtttgaacggtgaggtgtcaggtcatcaaatattcatgtctatatagtcttacacaggttctcaaaaaaaatgttcatgggataggtcattgataatggattccttattctgagaactccagacgactgaaatatatgagagaaggaaaaggacatagtaggagcaggcctgagaaaaaaatgaaagtcagaaatctttaaaaaaatacaagatcttatttctatcttattttttctcctcttctgaaatatatatgaggattcctctccaaacccatggtttctctaagaattttgagtcatttgtatgacctcaaataattagttttagctgacctcacataactccttataataggagacatctttaatgtctgctattaaagaaggatgaaaattcctatgaccttctccccgattatccctttggcaatatagagtcaaataataacattgaccaatagtaaacatgctttgccaagaagtagaagatatattctctagccttagtttttcctcccaatttgcatttttgtaaaaataatgttgtatccacaaaggaaataaactttaaaaacccaagtgcactcattga

SEQ ID NO: 152880 - DNA, 2560 bp, Homo sapiens
  Payload ID: 10070
  Gene Symbol: MS4A1
  Gene Name: membrane-spanning 4-domains, subfamily A, member 1
  ENST ID: ENST00000532073
  CDS Start-End: 116-970
actcaccctcccagtgtgcttgagaaacaaactgcacccactgaactccgcagctagcatccaaatcagcccttgagatttgaggccttggagactcaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaa

SEQ ID NO: 152881 - DNA, 607 bp, Homo sapiens
  Payload ID: 10070
  Gene Symbol: MS4A1
  Gene Name: membrane-spanning 4-domains, subfamily A, member 1
  ENST ID: ENST00000533306
  CDS Start-End: 239-607
agtgtgcttgagaaacaaactgcacccactgaactccgcagctagcatccaaatcagcccttgagatttgaggccttggagactcagatcctgaacaagagagaacaaaatctctactttgatggaacttccattctgtggggaagagactgacaataagcaattaaataaataagaactcagcagtaggccttgcctcagatccaaggtcactcggaagaggccatgtctaccctcaatgacactcatggaggaaatgctgagagaagcattcagatgcatgacacaagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaat

SEQ ID NO: 152882 - DNA, 2296 bp, Homo sapiens
  Payload ID: 10071
  Gene Symbol: MS4A10
  Gene Name: membrane-spanning 4-domains, subfamily A, member 10
  Uniprot ID: Q96PG2
  ENST ID: ENST00000308287
  CDS Start-End: 97-900
tctctggggagctccggcagcgcaagagggcaaagcacagctggaagctcagagctgcagtcccaggtcctgggccagggcccccatccagcatcaatgaaagcagaagccacagttattcccagccgttgtgctagggggctcccatcatggcaagtcctcagcccagtccagccctggcagacaagtgcaccccagaacacgacccagcccaagctcctggctccacaccagcacgagaagtcccagaagaagagcagccttcttaaggagctgggggccttccacatcaccatcgctctgctgcacctggtctttgggggctacctggcctctatagtcaagaaccttcacctggtggtgctgaagtcttggtatccattctggggggctgcctcttttctcatttcagggatcttggcgataacaatgaagaccttttctaaaacttacctgaagatgttgtgcctgatgacaaacctcatcagcctcttttgcgtgctgtctggcctcttcgtcatctccaaggatctctttctggagagcccatttgagtccccgatctggagaatgtaccccaactccacggtccacatccagaggctggagctggccttgctctgcttcactgtcctagagctcttcctgccagtgcccacagctgtcacagcctggagaggggactgcccatctgcaaagaatgatgatgcatgccttgttccgaatacaccattgcatctcaaaggcctgccggtggagcccccgccatcctaccagagtgtgattcaaggcgacgcacaacacaagcaacatcagaggctcagagaagttaagcaagttgccccggacacatggatagtcactgacggagctgcgatctggacccagactgcaaactgaagagccactgcctgacaatgcccaaacttggttggagcatagcccctgctctcccaaagttgcactttcactgggaagatgagatttgcacatacaaaaggctagagcgatggtctatacagcaaagtcagccctcacagctcctgggaacgctgtcctctcagataagccatttcttacatagttgatggctcgatatctgtggtggcccagattgttttgttttgtttcgctttgttttgttttcttttgttttgttgagatggagtctcgctctgttgcccagcccagagtacagtggcactatctcagctcactgcaatctccgcctccctggttcaagtgattctcctatctcagcctcccaagtagctgggactataggcacacgccaccacgcccagctaatttttatatttttagtagagacaggattgcaccatattggtcagcctggtctcaaactcctgacctcaggtgatccacctgcctcagcctcccaaagtgctgggattacaggcgtgagccactgtgcccagcccaggttttgaagttgtccgagatagcagtctgctctctactgccttataaaatccctgtgtgaagggatgctctcagtatcatttgcccttgcacagaatatccctggggtttgaggttctttgaattctccctctttgtcatctctttcgctgccacttctggctgtggtcactagcttggccatagcacctctcttctccacttctgatctgctgcttctaaccttctatagattgcagctggctttaaaatagattgtaaagtgtaaggcattaggttctgagacagcggcagagagagccatgcaaatgtttaggacaacccagtctttctttttttttttttttttttttttttttgagacggagtctcactctgtcacccaggctggagtgctgtggtgcaatctcggctcactgcaacctctgcctcccgagttcaagcaattctcctgcctcagcctcccgagtagctgggattacaggcgaccgccaccacgcctggctactttttgtatttttagtagagacagggtttcaccacgttagccatgatggtctcaaacttctgacctcataatccacccaccttggcctcccaaagtgctaggattacaggcatgagccaccacccctggctgaaacccaatctttcaaaacatgaaagggggtgatggagaaaaccttagcttggttgtctaaagacatgggtgcaaactctaggctagctctgccaatcacttactgtgcgggtttgactcagtcccttcccctcactaggtcccagtttctccatttgtaaaacaagcaattgtgctacattgatggtttacatcaataaaggttgaaacggc

SEQ ID NO: 152883 - DNA, 1167 bp, Homo sapiens
  Payload ID: 10072
  Gene Symbol: MS4A12
  Gene Name: membrane-spanning 4-domains, subfamily A, member 12
  Uniprot ID: Q9NXJ0
  ENST ID: ENST00000016913
  CDS Start-End: 58-861
acacaggttggagcagagaaagaggaaacatagaggtgccaaaggaacaaagacataatgatgtcatccaagccaacaagccatgctgaagtaaatgaaaccatacccaacccttacccaccaagcagctttatggctcctggatttcaacagcctctgggttcaatcaacttagaaaaccaagctcagggtgctcagcgtgctcagccctacggcatcacatctccgggaatctttgctagcagtcaaccgggtcaaggaaatatacaaatgataaatccaagtgtgggaacagcagtaatgaactttaaagaagaagcaaaggcactaggggtgatccagatcatggttggattgatgcacattggttttggaattgttttgtgtttaatatccttctcttttagagaagtattaggttttgcctctactgctgttattggtggatacccattctggggtggcctttcttttattatctctggctctctctctgtgtcagcatccaaggagctttcccgttgtctggtgaaaggcagcctgggaatgaacattgttagttctatcttggccttcattggagtgattctgctgctggtggatatgtgcatcaatggggtagctggccaagactactgggccgtgctttctggaaaaggcatttcagccacgctgatgatcttctccctcttggagttcttcgtagcttgtgccacagcccattttgccaaccaagcaaacaccacaaccaatatgtctgtcctggttattccaaatatgtatgaaagcaaccctgtgacaccagcgtcttcttcagctcctcccagatgcaacaactactcagctaatgcccctaaatagtaaaagaaaaaggggtatcagtctaatctcatggagaaaaactacttgcaaaaacttcttaagaagatgtcttttattgtctacaatgatttctagtctttaaaaactgtgtttgagatttgtttttaggttggtcgctaatgatggctgtatctcccttcactgtctcttcctacattaccactactacatgctggcaaaggtgaaggatcagaggactgaaaaatgattctgcaactctcttaaagttagaaatgtttctgttcatattactttttccttaataaaatgtcattagaaacaaaa

SEQ ID NO: 152884 - DNA, 578 bp, Homo sapiens
  Payload ID: 10072
  Gene Symbol: MS4A12
  Gene Name: membrane-spanning 4-domains, subfamily A, member 12
  ENST ID: ENST00000526784
  CDS Start-End: 58-578
acacaggttggagcagagaaagaggaaacatagaggtgccaaaggaacaaagacataatgatgtcatccaagccaacaagccatgctgaagtaaatgaaaccatacccaacccttacccaccaagcagctttatggctcctggatttcaacagcctctgggttcaatcaacttagaaaaccaagctcagggtgctcagcgtgctcagccctacggcatcacatctccgggaatctttgctagcagtcaaccgggtcaaggaaatatacaaatgataaatccaagtgtgggaacagcagtaatgaactttaaagaagaagcaaaggcactagggtttattatctctggctctctctctgtgtcagcatccaaggagctttcccgttgtctggtgaaaggcagcctgggaatgaacattgttagttctatcttggccttcattggagtgattctgctgctggtggatatgtgcatcaatggggtagctggccaagactactgggccgtgctttctggaaaaggcatttcagccacgctgatgatcttctccctcttggagttcttcgtagcttgtgccac

SEQ ID NO: 152885 - DNA, 582 bp, Homo sapiens
  Payload ID: 10072
  Gene Symbol: MS4A12
  Gene Name: membrane-spanning 4-domains, subfamily A, member 12
  ENST ID: ENST00000530007
  CDS Start-End: 240-582
aggaaacatagaggtgccaaaggaacaaagtaagtccattgatacgttcttgcctatctctcctccaaatcaatgggcacaaactgtggctggtctacctgtgtgggttctgttctctagattggagggatgaagacaagttcttgactctatgttgaggccagttgaaaaatgagggagaataaaaccatgaacgaaacaagaaagaaacaaaacagaagaggaatgaaaaagacataatgatgtcatccaagccaacaagccatgctgaagtaaatgaaaccatacccaacccttacccaccaagcagctttatggctcctggatttcaacagcctctgggttcaatcaacttagaaaaccaagctcagggtgctcagcgtgctcagccctacggcatcacatctccgggaatctttgctagcagtcaaccgggtcaaggaaatatacaaatgataaatccaagtgtgggaacagcagtaatgaactttaaagaagaagcaaaggcactaggggtgatccagatcatggttggattgatgcacattggttttggaattgttttgtgtttaatatccttct

SEQ ID NO: 152886 - DNA, 1019 bp, Homo sapiens
  Payload ID: 10072
  Gene Symbol: MS4A12
  Gene Name: membrane-spanning 4-domains, subfamily A, member 12
  Uniprot ID: Q9NXJ0
  ENST ID: ENST00000537076
  CDS Start-End: 58-723
acacaggttggagcagagaaagaggaaacatagaggtgccaaaggaacaaagacataatgatgtcatccaagccaacaagccatgctgaagtaaatgaaaccatacccaacccttacccaccaagcagctttatggctcctggatttcaacagcctctgggttcaatcaacttagaaaaccaagctcagggtgctcagcgtgctcagccctacggcatcacatctccgggaatctttgctagcagtcaaccgggtcaaggaaatatacaaatgataaatccaagtgtgggaacagcagtaatgaactttaaagaagaagcaaaggcactagggtttattatctctggctctctctctgtgtcagcatccaaggagctttcccgttgtctggtgaaaggcagcctgggaatgaacattgttagttctatcttggccttcattggagtgattctgctgctggtggatatgtgcatcaatggggtagctggccaagactactgggccgtgctttctggaaaaggcatttcagccacgctgatgatcttctccctcttggagttcttcgtagcttgtgccacagcccattttgccaaccaagcaaacaccacaaccaatatgtctgtcctggttattccaaatatgtatgaaagcaaccctgtgacaccagcgtcttcttcagctcctcccagatgcaacaactactcagctaatgcccctaaatagtaaaagaaaaaggggtatcagtctaatctcatggagaaaaactacttgcaaaaacttcttaagaagatgtcttttattgtctacaatgatttctagtctttaaaaactgtgtttgagatttgtttttaggttggtcgctaatgatggctgtatctcccttcactgtctcttcctacattaccactactacatgctggcaaaggtgaaggatcagaggactgaaaaatgattctgcaactctcttaaagttagaaatgtttctgttcatattactttttccttaataaaatgtcatt

SEQ ID NO: 152887 - DNA, 808 bp, Homo sapiens
  Payload ID: 10073
  Gene Symbol: MS4A13
  Gene Name: membrane-spanning 4-domains, subfamily A, member 13
  Uniprot ID: Q5J8X5
  ENST ID: ENST00000378185
  CDS Start-End: 324-662
gagccggccgggtgctgggctcctggctatccctgtgatggtagctcagcgagatctggggacctggcgctgagcgcgttgccagccgggatcttcctcttcatctaggcctgggcgctggcgtgagaactcggactgggtcctggacgagcgccccccgaaactccttggaaccttgaacaagtaaaatgcaggaagtttgctaataaagacatcaccaaaggttaaagagaaaatcatctagaggaaatgctggcagtatggcatgtgttctttaacaaatctctacagcagattctctcgttttagggactatccagattatgattggcatctttcacattttcatgtggtactttctattggttttgtatatgggacaaattaaaggagcctttggaacgtatgaacctgtaacttacaaaacaggatgtactttatggggaattttttttatcattgcaggagtcttcctaataagagtaacaaagtatccgactcgatctggaaaacttgggagggaagtatcacgtattttactgttcttctacggtttggaattttctattgcacttacacactcaatatacagctgttccaatttgtttcgaagacaaaatgatcttacatctgttactgaggaagctgagagcactccttaaaaaccctagaaatatgagaattttgctgttgctgatgcctggtgtgggtcctaatgatatctctgtataacaaagcagttacgaagcctacagattttgtgcaaaataaaatacaaacaaggtgaatttttctcctcattcaaaaa

SEQ ID NO: 152888 - DNA, 928 bp, Homo sapiens
  Payload ID: 10073
  Gene Symbol: MS4A13
  Gene Name: membrane-spanning 4-domains, subfamily A, member 13
  Uniprot ID: Q5J8X5
  ENST ID: ENST00000378186
  CDS Start-End: 324-782
gagccggccgggtgctgggctcctggctatccctgtgatggtagctcagcgagatctggggacctggcgctgagcgcgttgccagccgggatcttcctcttcatctaggcctgggcgctggcgtgagaactcggactgggtcctggacgagcgccccccgaaactccttggaaccttgaacaagtaaaatgcaggaagtttgctaataaagacatcaccaaaggttaaagagaaaatcatctagaggaaatgctggcagtatggcatgtgttctttaacaaatctctacagcagattctctcgttttagggactatccagattatgattggcatctttcacattttcatgtggtactttctattggttttgtatatgggacaaattaaaggagcctttggaacgtatgaacctgtaacttacaaaacaggatgtactttatggggaattttttttatcattgcaggagtcttcctaataagagtaacaaagtatccgactcgatctggaattataagtactttaatcataaacatcatctgcataattactacaattactgcagtaactctaacaataatagagttgtctcattttaattctgtgtcatacaggaattatggacaagcaaaacttgggagggaagtatcacgtattttactgttcttctacggtttggaattttctattgcacttacacactcaatatacagctgttccaatttgtttcgaagacaaaatgatcttacatctgttactgaggaagctgagagcactccttaaaaaccctagaaatatgagaattttgctgttgctgatgcctggtgtgggtcctaatgatatctctgtataacaaagcagttacgaagcctacagattttgtgcaaaataaaatacaaacaaggtgaatttttctcctcattcaaaaa

SEQ ID NO: 152889 - DNA, 751 bp, Homo sapiens
  Payload ID: 10073
  Gene Symbol: MS4A13
  Gene Name: membrane-spanning 4-domains, subfamily A, member 13
  Uniprot ID: Q5J8X5
  ENST ID: ENST00000437058
  CDS Start-End: 324-605
gagccggccgggtgctgggctcctggctatccctgtgatggtagctcagcgagatctggggacctggcgctgagcgcgttgccagccgggatcttcctcttcatctaggcctgggcgctggcgtgagaactcggactgggtcctggacgagcgccccccgaaactccttggaaccttgaacaagtaaaatgcaggaagtttgctaataaagacatcaccaaaggttaaagagaaaatcatctagaggaaatgctggcagtatggcatgtgttctttaacaaatctctacagcagattctctcgttttagggactatccagattatgattggcatctttcacattttcatgtggtactttctattggttttgtatatgggacaaattaaaggagcctttggaacgtatgaacctgtaacttacaaaacaggatgtactttatggggaatttttaaacttgggagggaagtatcacgtattttactgttcttctacggtttggaattttctattgcacttacacactcaatatacagctgttccaatttgtttcgaagacaaaatgatcttacatctgttactgaggaagctgagagcactccttaaaaaccctagaaatatgagaattttgctgttgctgatgcctggtgtgggtcctaatgatatctctgtataacaaagcagttacgaagcctacagattttgtgcaaaataaaatacaaacaaggtgaatttttctcctcattcaaaaa

SEQ ID NO: 152890 - DNA, 790 bp, Homo sapiens
  Payload ID: 10073
  Gene Symbol: MS4A13
  Gene Name: membrane-spanning 4-domains, subfamily A, member 13
  ENST ID: ENST00000527948
  CDS Start-End: 559-744
gaactcggactgggtcctggacgagcgccccccgaaactccttggaaccttgaacaagtaaaatgcagggtagtgatgtcgctttgctggagtgctttcgtgtcagaagccataaagggacacggaggctgattacggtgttcctctccctatcatactctgtaaacagtaggcactatttactactcagagatgatagctgtaaaatgccgatatgttttagtcatagagagagacttttcagttatgaaggctgttattcagaacagatggatgaaagttgatgcctctaatattaaggcctagaaagaagaaagaaggctattgcttctgaatttggagaggtggtgactgaacaataaggaaaggatcaaacttacgtattttcttctaagaaaataatgtatatgtgctttgtactgttttgtagaagtttgctaataaagacatcaccaaaggttaaagagaaaatcatctagaggaaatgctggcagtatggcatgtgttctttaacaaatctctacagcagattctctcgttttagggactatccagattatgattggcatctttcacattttcatgtggtactttctattggttttgtatatgggacaaattaaaggagcctttggaacgtatgaacctgtaacttacaaaacaggatgtactttatggggaattttttttcgaagacaaaatgatcttacatctgttactgaggaagctgagagcactccttaaaaaccctagaaatatgagaattttgctgttgctgatgcctggtgtg

SEQ ID NO: 152891 - DNA, 2997 bp, Homo sapiens
  Payload ID: 10074
  Gene Symbol: MS4A14
  Gene Name: membrane-spanning 4-domains, subfamily A, member 14
  Uniprot ID: Q96JA4
  ENST ID: ENST00000300187
  CDS Start-End: 278-2317
catctattctttgtttaccatatgtttgtaagcaaattgacaagagagtaagtcttctggatacagtacttttcaccaggaagatggggggctgagcatgctctagaattctaaaactctgtgactcaactatgattctgagattctactactgagtagagtcatcactaagggctcatctctgagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcattgtgggctttggaactatatttgcacttaattacatcggtttctcccaaagacttccccttgttgtcctcacaggatatccattctggggagcacttatttttattcttacaggatacctcacagtaaccgataagaaatcaaaacttctgggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgttctgtttttcttgccttcggatgttactcaaaatagtgaacaacctgccccagaagaaaatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaaaaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatggacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaa

SEQ ID NO: 152892 - DNA, 3401 bp, Homo sapiens
  Payload ID: 10074
  Gene Symbol: MS4A14
  Gene Name: membrane-spanning 4-domains, subfamily A, member 14
  ENST ID: ENST00000395001
  CDS Start-End: 566-2653
atcaagtaaaagaaactcctttcaaaggagggcagaagcgtggctgagtttaaaaaacatagattttggagacaggtcaagttgagtttgccccttccctgtcctgtatgtctttgggtgacataaccttgctgttcctcagtttcagtattgtagaactgttaaaagaataaatgttagtgcatgtcaacaccttctacacagttcccagaacataaggaatattccataagttttagttcctttataactcatgaacatatgtgtaaggacttgtttcgtatataccatctattctttgtttaccatatgtttgtaagcaaattgacaagagagtaagtcttctggatacagtacttttcaccaggaagatggggggctgagcatgctctagaattctaaaactctgtgactcaactatgattctgagattctactactgagtagagtcatcactaagggctcatctctgagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcattgtgggctttggaactatatttgcacttaattacatcggtttctcccaaagacttccccttgttgtcctcacaggatatccattctggggagcacttattggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattggaattttgttaatcttactgatcatcagcatagcagagctcagcatctctgtgactattgcatcctttagaagcaagtgctggacacagtcagatgaggttctgtttttcttgccttcggatgttactcaaaatagtgaacaacctgccccagaagaaaatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaaaaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatggacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaatgttaacactgtatcatcactttatgtatgtgaagaaataattcacatgtatattccttgtcatcaaa

SEQ ID NO: 152893 - DNA, 2813 bp, Homo sapiens
  Payload ID: 10074
  Gene Symbol: MS4A14
  Gene Name: membrane-spanning 4-domains, subfamily A, member 14
  Uniprot ID: Q96JA4
  ENST ID: ENST00000395005
  CDS Start-End: 145-2133
gattctgagattctactactgagtagagtcatcactaagggctcatctctgagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcattgtgggctttggaactatatttgcacttaattacatcggtttctcccaaagacttccccttgttgtcctcacaggatatccattctggggagcacttattggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgttctgtttttcttgccttcggatgttactcaaaatagtgaacaacctgccccagaagaaaatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaaaaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatggacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaa

SEQ ID NO: 152894 - DNA, 590 bp, Homo sapiens
  Payload ID: 10074
  Gene Symbol: MS4A14
  Gene Name: membrane-spanning 4-domains, subfamily A, member 14
  ENST ID: ENST00000531949
  CDS Start-End: 84-368
gtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcattgtgggctttggaactatatttgcacttaattacatcggtttctcccaaagacttccccttgttgtcctcacaggatatccattctggggagcacttattgtgagtactgtcgattagaagctttggagaaattgctataaagatagatttgaactgcttcacgtcctagggtaatgaattccataaatatggccctccaggagaccaaaaaaggcagctcccttcacggcaaaagaagcaactccatttggtcactgcactaccatcatcattgtaataactactctcagtttattcttacaggatacctcacagtaaccgataagaaatcaaaacttc

SEQ ID NO: 152895 - DNA, 451 bp, Homo sapiens
  Payload ID: 10074
  Gene Symbol: MS4A14
  Gene Name: membrane-spanning 4-domains, subfamily A, member 14
  ENST ID: ENST00000534688
  CDS Start-End: 1-419
caagagtcttgggggctacccagatcctgcttgctctaatcattgtgggctttggaactatatttgcacttaattacatcggtttctcccaaagacttccccttgttgtcctcacaggatatccattctggggagcacttatttttattcttacaggatacctcacagtaaccgataagaaatcaaaacttctgggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgtaagtggtcttattttgcatgaagaatccctaaaatcttctctgaactgtgtccatgatgtaatgattcactgatttttattttattaaatgaagttgtgtcagca

SEQ ID NO: 152896 - DNA, 2910 bp, Homo sapiens
  Payload ID: 10074
  Gene Symbol: MS4A14
  Gene Name: membrane-spanning 4-domains, subfamily A, member 14
  Uniprot ID: Q96JA4
  ENST ID: ENST00000531783
  CDS Start-End: 92-2230
ggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcattgtgggctttggaactatatttgcacttaattacatcggtttctcccaaagacttccccttgttgtcctcacaggatatccattctggggagcacttatttttattcttacaggatacctcacagtaaccgataagaaatcaaaacttctgggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattggaattttgttaatcttactgatcatcagcatagcagagctcagcatctctgtgactattgcatcctttagaagcaagtgctggacacagtcagatgaggttctgtttttcttgccttcggatgttactcaaaatagtgaacaacctgccccagaagaaaatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaaaaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatggacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaa

SEQ ID NO: 152897 - DNA, 2815 bp, Homo sapiens
  Payload ID: 10074
  Gene Symbol: MS4A14
  Gene Name: membrane-spanning 4-domains, subfamily A, member 14
  ENST ID: ENST00000525397
  CDS Start-End: 100-612
tctctgagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcattgtgggctttggaactatatttgcacttaattacatcggtttctcccaaagacttccccttgttgtcctcacaggatatccattctggggagcacttatttttattcttacaggatacctcacagtaaccgataagaaatcaaaacttctgggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgacttcatccttctcactcctccacactccagccacttcctataatcccttaatgtgtcaagtatccacggccccaagatgatcagaggatcagcttcttccggctttgaaccgtcaccaggttctgtttttcttgccttcggatgttactcaaaatagtgaacaacctgccccagaagaaaatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaaaaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatggacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaa

SEQ ID NO: 152898 - DNA, 2898 bp, Homo sapiens
  Payload ID: 10074
  Gene Symbol: MS4A14
  Gene Name: membrane-spanning 4-domains, subfamily A, member 14
  ENST ID: ENST00000527841
  CDS Start-End: 112-573
actaagggctcatctctgagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcattgtgggctttggaactatatttgcacttaattacatcggtttctcccaaagacttccccttgttgtcctcacaggatatccattctggggagcacttattggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgacttcatccttctcactcctccacactccagccacttcctataatcccttaatgtgtcaagtatccacggccccaagatgatcagaggatcagcttcttccggctttgaaccgtcaccaggttctgtttttcttgccttcggatgttactcaaaatagtgaacaacctgccccagaagaaaatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaaaaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatggacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaacc

SEQ ID NO: 152899 - DNA, 559 bp, Homo sapiens
  Payload ID: 10074
  Gene Symbol: MS4A14
  Gene Name: membrane-spanning 4-domains, subfamily A, member 14
  ENST ID: ENST00000526375
  CDS Start-End: 115-559
atcactaagggctcatctctgagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcattgtgggctttggaactatatttgcacttaattacatcggtttctcccaaagacttccccttgttgtcctcacaggatatccattctggggagcacttattggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattggaattttgttaatcttactgatcatca

SEQ ID NO: 152900 - DNA, 2997 bp, Homo sapiens
  Payload ID: 10074
  Gene Symbol: MS4A14
  Gene Name: membrane-spanning 4-domains, subfamily A, member 14
  ENST ID: ENST00000530662
  CDS Start-End: 112-573
actaagggctcatctctgagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcattgtgggctttggaactatatttgcacttaattacatcggtttctcccaaagacttccccttgttgtcctcacaggatatccattctggggagcacttattggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgacttcatccttctcactcctccacactccagccacttcctataatcccttaatgtgtcaagtatccacggccccaagatgatcagaggatcagcttcttccggctttgaaccgtcaccagggaattttgttaatcttactgatcatcagcatagcagagctcagcatctctgtgactattgcatcctttagaagcaagtgctggacacagtcagatgaggttctgtttttcttgccttcggatgttactcaaaatagtgaacaacctgccccagaagaaaatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaaaaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatggacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaacc

SEQ ID NO: 152901 - DNA, 2537 bp, Homo sapiens
  Payload ID: 10074
  Gene Symbol: MS4A14
  Gene Name: membrane-spanning 4-domains, subfamily A, member 14
  ENST ID: ENST00000531787
  CDS Start-End: 154-1857
ggaagtctcagaggctggagagcagagcaccaagatcgttctggcaggaacagccagtgggaggttccagctgagcgctccccagaggtgagctgatccccagccacagcacacaggaccaggctgcgagaacagggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgttctgtttttcttgccttcggatgttactcaaaatagtgaacaacctgccccagaagaaaatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaaaaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatggacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaa

SEQ ID NO: 152902 - DNA, 1536 bp, Homo sapiens
  Payload ID: 10075
  Gene Symbol: MS4A15
  Gene Name: membrane-spanning 4-domains, subfamily A, member 15
  Uniprot ID: Q8N5U1
  ENST ID: ENST00000337911
  CDS Start-End: 77-520
atcgccttgaagttacgcttgaaggaggaaaactcatcaattttcggggaatcccggctttggcagcgtgctgctcatggttcgccgcggccacgtgggcatcttcttcatcgagggcggcgtccccttctggggaggagcctgcttcatcatctccggatccctctcagtggcagccgagaagaaccacaccagttgcctggtgaggagcagcctgggcaccaacatcctcagcgtcatggcggcctttgctgggacagccattctgctcatggattttggtgttaccaaccgggatgtggacaggggctatctggccgtgcttactatcttcactgtcctggagttcttcacagcggtcattgccatgcacttcgggtgccaagccatccatgcccaggccagtgcacctgtgatcttcctgccaaacgccttcagcgcagacttcaacatccccagcccggcagcctctgcgccccctgcctatgacaatgtggcatatgcccaaggagtcgtctgagtagcagatgtggcacctgcgggtggagtccagccttttccctctgggcccagcctctccccacccccaccttgttcatcaggggccagccccatcccagctgccctccctcaccacatctacacatactccggcatctgagtgaagtgtccccagggacatctctcccacactttccccagtgctttctttctaaaagacaccgggctgacgtcaggggtgtgtgtccttcagctccctgagccctgtcacccttccaggacacccaccttgtgcatctaagcatttctctgctcattggggaaatcctggcctcattggagactcaggttcgaggcctgccctgaccctcgggcctcgggaaggtcagagagcccggaatcctccagaatggaagagtctgactctggcattccacagaggtgccgataccaggccaaggcctcacagcagggtagtggcctggccgcaggtctcctggccccaagatcagctctgtcctttgtcatctgttgccacatccatggaactcaggtttcctatttggaaactagagtgttgaaccagataaggttcatcaggcccttccagctccccaggctccctgaagtcctgggtctaggccaggcattgtccccctgcttcctggaaaccctcattttccttgtctgtaatatgaagtcagcattggccccgccccccaccccctaccatctcccaatggaggggaggttgcaggggagagctgccgccagcccactcctgaggcaccaccacagtcagcatcgacaggggcacagcagtggcagtttgggacctccctgtgcctctcagcactcccttccccacccccatagcccaaggacaaggctaccacagaaggttaccacaggacctgggcttcgtctccaggggacaaggagacactgtcagcctggtgttcaccaggcctggtagatgagatggcttgtctcatccacaccacagaaggaaataaaccatgtggcttaaatttt

SEQ ID NO: 152903 - DNA, 1818 bp, Homo sapiens
  Payload ID: 10075
  Gene Symbol: MS4A15
  Gene Name: membrane-spanning 4-domains, subfamily A, member 15
  Uniprot ID: Q8N5U1
  ENST ID: ENST00000405633
  CDS Start-End: 80-802
cttgaagttacgcttgaaggaggaaaactcatcaattttcggggaatcccgcctttgtttcccaggctctctgagcacgatgtctgcagctcccgccagcaatggagtgtttgttgtcatcccgccaaacaacgccagtggcctctgcccacctccggccattctgcccacatccatgtgccaacctccagggattatgcagtttgaggagccaccgctgggggcacagacaccaagggccacacagccacctgacttgcggcccgtggagacattcctgacaggagagcccaaagttttggggacggtgcagatcctcatcggcctcatccacctaggctttggcagcgtgctgctcatggttcgccgcggccacgtgggcatcttcttcatcgagggcggcgtccccttctggggaggagcctgcttcatcatctccggatccctctcagtggcagccgagaagaaccacaccagttgcctggtgaggagcagcctgggcaccaacatcctcagcgtcatggcggcctttgctgggacagccattctgctcatggattttggtgttaccaaccgggatgtggacaggggctatctggccgtgcttactatcttcactgtcctggagttcttcacagcggtcattgccatgcacttcgggtgccaagccatccatgcccaggccagtgcacctgtgatcttcctgccaaacgccttcagcgcagacttcaacatccccagcccggcagcctctgcgccccctgcctatgacaatgtggcatatgcccaaggagtcgtctgagtagcagatgtggcacctgcgggtggagtccagccttttccctctgggcccagcctctccccacccccaccttgttcatcaggggccagccccatcccagctgccctccctcaccacatctacacatactccggcatctgagtgaagtgtccccagggacatctctcccacactttccccagtgctttctttctaaaagacaccgggctgacgtcaggggtgtgtgtccttcagctccctgagccctgtcacccttccaggacacccaccttgtgcatctaagcatttctctgctcattggggaaatcctggcctcattggagactcaggttcgaggcctgccctgaccctcgggcctcgggaaggtcagagagcccggaatcctccagaatggaagagtctgactctggcattccacagaggtgccgataccaggccaaggcctcacagcagggtagtggcctggccgcaggtctcctggccccaagatcagctctgtcctttgtcatctgttgccacatccatggaactcaggtttcctatttggaaactagagtgttgaaccagataaggttcatcaggcccttccagctccccaggctccctgaagtcctgggtctaggccaggcattgtccccctgcttcctggaaaccctcattttccttgtctgtaatatgaagtcagcattggccccgccccccaccccctaccatctcccaatggaggggaggttgcaggggagagctgccgccagcccactcctgaggcaccaccacagtcagcatcgacaggggcacagcagtggcagtttgggacctccctgtgcctctcagcactcccttccccacccccatagcccaaggacaaggctaccacagaaggttaccacaggacctgggcttcgtctccaggggacaaggagacactgtcagcctggtgttcaccaggcctggtagatgagatggcttgtctcatccacaccacagaaggaaataaaccatgtggcttaaatttt

SEQ ID NO: 152904 - DNA, 2110 bp, Homo sapiens
  Payload ID: 10075
  Gene Symbol: MS4A15
  Gene Name: membrane-spanning 4-domains, subfamily A, member 15
  ENST ID: ENST00000429322
  CDS Start-End: 84-647
tcgccttgaagttacgcttgaaggaggaaaactcatcaattttcggggaatcccgcctttgtttcccaggctctctgagcacgatgtctgcagctcccgccagcaatggagtgtttgttgtcatcccgccaaacaacgccagtggcctctgcccacctccggccattctgcccacatccatgtgccaacctccagggattatgcagtttgaggagccaccgctgggggcacagacaccaagggccacacagccacctgacttgcggcccgtggagacattcctgacaggagagcccaaagttttgggggctttggcagcgtgctgctcatggttcgccgcggccacgtgggcatcttcttcatcgagggcggcgtccccttctggggaggagcctgcttcatcatctccggatccctctcagtggcagccgagaagaaccacaccagttgcctgctcattccccagcacttcaggggacctgcaaagtgccaggggaggggcaccacccaggcagaccagacgcagactgtgcatgtccaggagaagaagacagggatactctttcaatacacaagccagggtggaaagtgaggtccatgctcatggtcattccgagaaaggaaagatgctagaagatctcctgtaagagtcctgctgggccttggtgagcagagaggacttagaaataccacagggaaagctggagaatgcacggaggagtgtgggcagggtcgccactgaaaccacgcctggctccatccaacgaaggcaaaggtgaggagcagcctgggcaccaacatcctcagcgtcatggcggcctttgctgggacagccattctgctcatggattttggtgttaccaaccgggatgtggacaggggctatctggccgtgcttactatcttcactgtcctggagttcttcacagcggtcattgccatgcacttcgggtgccaagccatccatgcccaggccagtgcacctgtgatcttcctgccaaacgccttcagcgcagacttcaacatccccagcccggcagcctctgcgccccctgcctatgacaatgtggcatatgcccaaggagtcgtctgagtagcagatgtggcacctgcgggtggagtccagccttttccctctgggcccagcctctccccacccccaccttgttcatcaggggccagccccatcccagctgccctccctcaccacatctacacatactccggcatctgagtgaagtgtccccagggacatctctcccacactttccccagtgctttctttctaaaagacaccgggctgacgtcaggggtgtgtgtccttcagctccctgagccctgtcacccttccaggacacccaccttgtgcatctaagcatttctctgctcattggggaaatcctggcctcattggagactcaggttcgaggcctgccctgaccctcgggcctcgggaaggtcagagagcccggaatcctccagaatggaagagtctgactctggcattccacagaggtgccgataccaggccaaggcctcacagcagggtagtggcctggccgcaggtctcctggccccaagatcagctctgtcctttgtcatctgttgccacatccatggaactcaggtttcctatttggaaactagagtgttgaaccagataaggttcatcaggcccttccagctccccaggctccctgaagtcctgggtctaggccaggcattgtccccctgcttcctggaaaccctcattttccttgtctgtaatatgaagtcagcattggccccgccccccaccccctaccatctcccaatggaggggaggttgcaggggagagctgccgccagcccactcctgaggcaccaccacagtcagcatcgacaggggcacagcagtggcagtttgggacctccctgtgcctctcagcactcccttccccacccccatagcccaaggacaaggctaccacagaaggttaccacaggacctgggcttcgtctccaggggacaaggagacactgtcagcctggtgttcaccaggcctggtagatgagatggcttgtctcatccacaccacagaaggaaataaaccatgtggcttaaattttg

SEQ ID NO: 152905 - DNA, 818 bp, Homo sapiens
  Payload ID: 10075
  Gene Symbol: MS4A15
  Gene Name: membrane-spanning 4-domains, subfamily A, member 15
  Uniprot ID: Q8N5U1
  ENST ID: ENST00000528170
  CDS Start-End: 135-734
cttggcgttcactgcaagctataagctctgcaagtggtgaccccgacgtgatcgccttgaagttacgcttgaaggaggaaaactcatcaattttcggggaatcccgcctttgtttcccaggctctctgagcacgatgtctgcagctcccgccagcaatggagtgtttgttgtcatcccgccaaacaacgccagtggcctctgcccacctccggccattctgcccacatccatgtgccaacctccagggattatgcagtttgaggagccaccgctgggggcacagacaccaagggccacacagccacctgacttgcggcccgtggagacattcctgacaggagagcccaaagttttggggttcatcatctccggatccctctcagtggcagccgagaagaaccacaccagttgcctggtgaggagcagcctgggcaccaacatcctcagcgtcatggcggcctttgctgggacagccattctgctcatggattttggtgttaccaaccgggatgtggacaggggctatctggccgtgcttactatcttcactgtcctggagttcttcacagcggtcattgccatgcacttcgggtgccaagccatccatgcccaggccagtgcacctgtgatcttcctgccaaacgccttcagcgcagacttcaacatccccagcccggcagcctctgcgccccctgcctatgacaatgtggcatatgcccaaggagtcgtctgagtagcagatgtggcacctgcgggtggagtccagccttttccctctgggcccagcctctccccacccccaccttgttcatcaggg

SEQ ID NO: 152906 - DNA, 969 bp, Homo sapiens
  Payload ID: 10076
  Gene Symbol: MS4A18
  Gene Name: membrane-spanning 4-domains, subfamily A, member 18
  Uniprot ID: Q3C1V0
  ENST ID: ENST00000398983
  CDS Start-End: 1-969
atgaccgaacaggtgattggagccaacagtgtacctggcattattgccccagataatgttcacgtcatccagcccagcaaccctgtggcctctggaaatcatctgcagccttcagaggtgaccacttacccaatctcaccaaaagtaatccactgtgatacaggaagagcaaacttacagaatctactcgtggtgaaccagaactcagcagcaggtgtacagagtcaacccattgggtatcagcgacagtatccagtgggaacagccagtttgcagacggtgcctggagtgatccaatacacacagggaaccacgaatctccagacatggcctggagaccttcagaatcctctgaatgctaaccctgggctgacacacacctcaaactcatcccagtggaacacgtcatttgcatcatttacttcatttaatcccaagaaattcataaatgaggaggtcagaacattaggggccatccagatcctcatcggcctgacgcacattttctctgcaattaaccctgtgctgtattactatccttttgtgacctggttgtcagggtacccgctctggggaggattatcctatattgtatctggatccctctcagtatgggctgcaaaggaccccagtccttgtgtggtgaacagcagcatcagcttcaacatcatcagcgcactcttcgcctttgccgggatcttcattatcattacagatctgagcctttactatgtgacgacatattcaaaggcggtttctggcggtcttctcccctttgccctcctggagttcatcctcacttgtgtggtctcacattttgggtgccaggctacctgctgcagacaatttgagaatgtggcagtgattccaaccgtattcagtttcaacccagccaataccaccaccagccctgtcaatgctaccactggtcctgtcaatgctgccactggccctgtcagtgccaccaat

SEQ ID NO: 152907 - DNA, 1433 bp, Homo sapiens
  Payload ID: 10076
  Gene Symbol: MS4A18
  Gene Name: membrane-spanning 4-domains, subfamily A, member 18
  ENST ID: ENST00000529108
  CDS Start-End: 13-1215
cagttgtacaccatgaccgaacaggtgattggagccaacagtgtacctggcattattgccccagataatgttcacgtcatccagcccagcaaccctgtggcctctggaaatcatctgcagccttcagaggtgaccacttacccaatctcaccaaaagtaatccactgtgatacaggaagagcaaacttacagaatctactcgtggtgaaccagaactcagcagcaggtgtacagagtcaacccattgggtatcagcgacagtatccagtgggaacagccagtttgcagacggtgcctggagtgatccaatacacacagggaaccacgaatctccagacatggcctggagaccttcagaatcctctgaatgctaaccctgggctgacacacacctcaaactcatcccagtggaacacgtcatttgcatcatttacttcatttaatcccaagaaattcataaatgaggaggtcagaacattaggggtgagtgccatccagatcctcatcggcctgacgcacattttctctgcaattaaccctgtgctgtattactatccttttgtgacctggttgtcagggtacccgctctggggaggattatcctatattgtatctggatccctctcagtatgggctgcaaaggaccccagtccttgtgtggtgaacagcagcatcagcttcaacatcatcagcgcactcttcgcctttgccgggatcttcattatcattacagatctgagcctttactatgtgacgacatattcaaaggcggtttctggcggtcttctcccctttgccctcctggagttcatcctcacttgtgtggtctcacattttgggtgccaggctacctgctgcagacaatttgagaatgtggcagtgattccaaccgtattcagtttcaacccagccaataccaccaccagccctgtcaatgctaccactggtcctgtcaatgctgccactggccctgtcagtgccaccaatggtcctgtcaatactaccattcaccctgtcaacaccaccaccagccctgtcaacaccaccaccagccctgtcaatgttaccactggtcctgtcaatgctaacattggccctgtcaatgtgacaactggccccgttaacactaccactgcccctgccaaagctaccaccagttgtgtcaatgctatccacaccagcaatgtacccccgaaccctcgtaccaagaaatagctgatttgcacagagatagatgacatgggatgcctgtctcaatgacaaggggatacactgtagctgtatcttttcttctccctgaaacttccatgaccatgaccctagccttgttgccagactgaaatgaacaagcatttcctctcctcttcactcctaagcttcatttttgtttgttattgatgtcttttttttcattcataaataattttcctttg

SEQ ID NO: 152908 - DNA, 1152 bp, Homo sapiens
  Payload ID: 10077
  Gene Symbol: MS4A2
  Gene Name: membrane-spanning 4-domains, subfamily A, member 2
  Uniprot ID: Q01362
  ENST ID: ENST00000278888
  CDS Start-End: 103-837
aacccatttcaactgcctattcagagcatgcagtaagaggaaatccaccaagtctcaatataataatattctttattcctggacagctcggttaatgaaaaaatggacacagaaagtaataggagagcaaatcttgctctcccacaggagccttccagtgtgcctgcatttgaagtcttggaaatatctccccaggaagtatcttcaggcagactattgaagtcggcctcatccccaccactgcatacatggctgacagttttgaaaaaagagcaggagttcctgggggtaacacaaattctgactgctatgatatgcctttgttttggaacagttgtctgctctgtacttgatatttcacacattgagggagacattttttcatcatttaaagcaggttatccattctggggagccatatttttttctatttctggaatgttgtcaattatatctgaaaggagaaatgcaacatatctggtgagaggaagcctgggagcaaacactgccagcagcatagctgggggaacgggaattaccatcctgatcatcaacctgaagaagagcttggcctatatccacatccacagttgccagaaattttttgagaccaagtgctttatggcttccttttccactgaaattgtagtgatgatgctgtttctcaccattctgggacttggtagtgctgtgtcactcacaatctgtggagctggggaagaactcaaaggaaacaaggttccagaggatcgtgtttatgaagaattaaacatatattcagctacttacagtgagttggaagacccaggggaaatgtctcctcccattgatttataagaatcacgtgtccagaacactctgattcacagccaaggatccagaaggccaaggtcttgttaaggggctactggaaaaatttctattctctccacagcctgctggttttacattagatttattcgcctgataagaatattttgtttctgctgcttctgtccaccttaatattctccttctatttgtagatatgatagactcctatttttcttgttttatattatgaccacacacatctctgctggaaagtcaacatgtagtaagcaagatttaactgtttgattataactgtgcaaatacagaaaaaaagaaggc

SEQ ID NO: 152909 - DNA, 541 bp, Homo sapiens
  Payload ID: 10077
  Gene Symbol: MS4A2
  Gene Name: membrane-spanning 4-domains, subfamily A, member 2
  ENST ID: ENST00000524868
  CDS Start-End: 418-541
ttcagttttgggtctatgtgtgaaaccaagcatgccttaaacaaggaagacaagcttttcaaaggtgcaattggataacttctgccatagaaatggctgaattgggacacaagtggggacaattccagaagaagggcacatctctttcttttctgcagttctttctcaccttctcaactcctactaaaatgtctcattttcaggttctgtaaatcctgctagtctcaggcaaaattatgctccaggagtctcaaattttcttatttcatattagtctttatttagtagacttcttaatttttctattcatcacaagtaaaagcctgttgatcttaatcagccaagaaacttatctgtctggcaaatgacttatgtataaagagaatcatcaatgtcatgagctcggttaatgaaaaaatggacacagaaagtaataggagagcaaatcttgctctcccacaggagccttccagtgtgcctgcatttgaagtcttggaaatatctccccaggaagtatcttcaggcagactattgaagtcgg

SEQ ID NO: 152910 - DNA, 3512 bp, Homo sapiens
  Payload ID: 10077
  Gene Symbol: MS4A2
  Gene Name: membrane-spanning 4-domains, subfamily A, member 2
  ENST ID: ENST00000617306
  CDS Start-End: 103-702
aacccatttcaactgcctattcagagcatgcagtaagaggaaatccaccaagtctcaatataataatattctttattcctggacagctcggttaatgaaaaaatggacacagaaagtaataggagagcaaatcttgctctcccacaggagccttccagtgtgcctgcatttgaagtcttggaaatatctccccaggaagtatcttcaggcagactattgaagtcggcctcatccccaccactgcatacatggctgacagttttgaaaaaagagcaggagttcctggggttttctatttctggaatgttgtcaattatatctgaaaggagaaatgcaacatatctggtgagaggaagcctgggagcaaacactgccagcagcatagctgggggaacgggaattaccatcctgatcatcaacctgaagaagagcttggcctatatccacatccacagttgccagaaattttttgagaccaagtgctttatggcttccttttccactgaaattgtagtgatgatgctgtttctcaccattctgggacttggtagtgctgtgtcactcacaatctgtggagctggggaagaactcaaaggaaacaaggttccagaggatcgtgtttatgaagaattaaacatatattcagctacttacagtgagttggaagacccaggggaaatgtctcctcccattgatttataagaatcacgtgtccagaacactctgattcacagccaaggatccagaaggccaaggtcttgttaaggggctactggaaaaatttctattctctccacagcctgctggttttacattagatttattcgcctgataagaatattttgtttctgctgcttctgtccaccttaatattctccttctatttgtagatatgatagactcctatttttcttgttttatattatgaccacacacatctctgctggaaagtcaacatgtagtaagcaagatttaactgtttgattataactgtgcaaatacagaaaaaaagaaggctggctgaaagttgagttaaactttgacagtttgataatatttggttcttagggtttttttttttttttagcattcttaatagttacagttgggcatgatttgtaccatccacccatacccacacagtcacagtcacacacacatatgtattacttacactatatataacttcctatgcaaatattttaccaccagtcaataatacatttttgccaagacatgaagttttataaagatctgtataattgcctgaatcaccagcacattcactgacatgatattatttgcagattgacaagtaggaagtggggaattttattaagttactcgttgtctggggaggtaaataggttaaaaacagggaaattataagtgcagagattaacatttcacaaatgtttagtgaaacatttgtgaaaaaagaagactaaattaagacctgagctgaaataaagtgagtggaaatggaaataatggttatatctaaaacatgtagaaaaagagtaactggtagattttgttaacaaattaaagaataaagttagacaagcaactggttgactaatacattaagcgtttgagtctaagatgaaaggagaacactggttatgttgatagaatgataaaaagggtcgggcgcggaggctcacgcctgtaatcccagccctttgggaggccgaggtgggcagatcacgaagtcagtagtttgagaccagcctggccaacatagtgaaaccccgtctctactaaaaatacaaaaaaaaaattagctgggtgtggtggcagtcacctgtagtcccagctacttgggaggctgaggcaggagaatcgcttcaacctgggaggcggaggttgcagtgagccgagatcgcaccagtgcactccagccttggtgacaatgggagactccatctcaaaaaaaaaaaaaaaaaaaaaaaagataaaaagtcagaaatctgaaaagtggaggaagagtacaaatagacctaaattaagctcatttttaggctttgattttggggagacaaagggaaatgcagccatagagggcctgatgacatccaatacagagttctggtaaagataaaatttgatacaggtttggtgtcattataagagaaatcattattaaatgaagcaagttaacactctaagagaattattttgagatagaagtgaagctaagctaaacttcacatgcctataattggagggaaaaactaaggataaaatctagcctagaagatacaataattagtcataaacatgcattgtgaaactgtagagagcaggtagcccaaaatagagaaagattagataaagagaaaataagtatccatcagagacagtatctctaggcttgggcaagagaaaagtccacagtgataagcaactccacctaaggcatgaatatgcggcagagaaaacagcaatagtgaatgaatgcaaaaggtgctgagaaattccacacatgagtattgtgatgagtaaatgaataaaacatttgcaaagacctttagagaaagagaatgggagcatatgtgagaaataagatagttgattatgaatagaaggtagtgaagaaaagcaagctaagaaaaaattctgtttataaaagaaggaaaagatagtttatgtttttagcctaagtataagagtcctacagatggactgaaaaaaatcagtctgagagtattagtcacaattaatgaaataattacattttatgtattgaggatgccaagattaaaaggtgacaggtagatgttaatttccctagattgtgaaagtgatcacgacaatcacacaacaaataattaagtgacttggtatgctttatttaattgtagggcctgaggttttccattctcatttttctaaaatacaattttgtttctccaaatttgacagcagaataaaaaccctaccctttcactgtgtatcatgctaagctgcatctctactcttgatcatctgtaggtattaatcacatcacttccatggcatggatgttcacatacagactcttaaccctggtttaccaggacctctaggagtggatccaatctatatctttacagttgtatagtatatgatatctcttttatttcactcaatttatattttcatcattgactacatatttcttatacacaacacacaatttatgaattttttctcaagatcattctgagagttgccccaccctacctgccttttatagtatgcccacctcaggcagacacagagcacaatgctggggttctcttcacactatcactgccccaaattgtctttctaaatttcaacttcaatgtcatcttctccatgaagaccactgaatgaacaccttttcatccagccttaatttcttgctccataactactctatcccacgatgcagtattgtatcattaattattagtgtgcttgtgacctccttatgtattctcaattacctgtatttgtgcaataaattggaataatgtaacttg

SEQ ID NO: 152911 - DNA, 1613 bp, Homo sapiens
  Payload ID: 10078
  Gene Symbol: MS4A3
  Gene Name: membrane-spanning 4-domains, subfamily A, member 3 (hematopoietic cell-specific)
  Uniprot ID: Q96HJ5
  ENST ID: ENST00000278865
  CDS Start-End: 74-718
acttgcgacaaggtggacttgggaggaaagccgtctgccaaagcctgaagcctccaagccataaacaaccccaatggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttggggccatccagatcctgaatgcagcaatgattctggctttgggtgtctttctgggttccttgcaatacccataccacttccaaaagcacttctttttcttcaccttctacacaggctacccgatttggggtgctgtgtttttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 152912 - DNA, 1516 bp, Homo sapiens
  Payload ID: 10078
  Gene Symbol: MS4A3
  Gene Name: membrane-spanning 4-domains, subfamily A, member 3 (hematopoietic cell-specific)
  Uniprot ID: Q96HJ5
  ENST ID: ENST00000358152
  CDS Start-End: 129-635
ggaggcttccgttatcgggaaaagatgctgtagtgatcttttctgagtgtctcctacttgcgacaaggtggacttgggaggaaagccgtctgccaaagcctgaagcctccaagccataaacaaccccaatggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttgggttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagc

SEQ ID NO: 152913 - DNA, 867 bp, Homo sapiens
  Payload ID: 10078
  Gene Symbol: MS4A3
  Gene Name: membrane-spanning 4-domains, subfamily A, member 3 (hematopoietic cell-specific)
  Uniprot ID: Q96HJ5
  ENST ID: ENST00000395032
  CDS Start-End: 230-505
ctctaaagtgttgcataaggcaaagataacgttaagtctgtggaggcttccgttatcgggaaaagatgctgtagtgatcttttctgagtgtctcctacttgcgacaaggtggacttgggaggaaagccgtctgccaaagcctgaagcctccaagttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatcccta

SEQ ID NO: 152914 - DNA, 746 bp, Homo sapiens
  Payload ID: 10078
  Gene Symbol: MS4A3
  Gene Name: membrane-spanning 4-domains, subfamily A, member 3 (hematopoietic cell-specific)
  ENST ID: ENST00000525686
  CDS Start-End: 54-305
gggaggaaagccgtctgccaaagcctgaagcctccaagccataaacaaccccaatggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttgggtctattcaacgtgaagaggatgaggatgaagacctttatgataatctacttccacttaatgaatattctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatc

SEQ ID NO: 152915 - DNA, 507 bp, Homo sapiens
  Payload ID: 10078
  Gene Symbol: MS4A3
  Gene Name: membrane-spanning 4-domains, subfamily A, member 3 (hematopoietic cell-specific)
  Uniprot ID: Q96HJ5
  ENST ID: ENST00000534744
  CDS Start-End: 1-507
atggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttgggttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaa

SEQ ID NO: 152916 - DNA, 1604 bp, Homo sapiens
  Payload ID: 10079
  Gene Symbol: MS4A4A
  Gene Name: membrane-spanning 4-domains, subfamily A, member 4A
  Uniprot ID: Q96JQ5
  ENST ID: ENST00000337908
  CDS Start-End: 91-810
aatgcagatttaaactgagtgaggtgtggagtgggggaagttgattgggtctagaccaaagaactttgaggaacttgcccagagccctgcatgcatcagacctacagcagacattgcaggcctgaagaaagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctggtccgaggtagtctaggaatgaatatcaccagctctgtactggctgcatcagggatcttaatcaacacatttagcttggcgttttattcattccatcacccttactgtaactactatggcaactcaaataattgtcatgggactatgtccatcttaatgggtctggatggcatggtgctcctcctaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgaggccaccaaaagatcaacagacaaatgctccagaaatctatgctgactgtgacacaagagcctcacatgagaaattaccagtatccaacttcgatactgatagacttgttgatattattattatatgtaatccaattatgaactgtgtgtgtatagagagataataaattcaaaattatgttctcatttttttccctggaactcaataactcatttcactggctctttatcgagagtactagaagttaaattaataaataatgcatttaatgaggcaacagcacttgaaagtttttcattcatcataagaactttatataaaggcattacattggcaaataaggtttggaagcagaagagcaaaaaaaagatattgttaaaatgaggcctccatgcaaaacacatacttccctcccatttatttaactttttttttctcctacctatggggaccaaagtgctttttccttcaggaagtggagatgcatggccatctccccctccctttttccttctcctgcttttctttccccatagaaagtaccttgaagtagcacagcccgtccttgcatgtgcacgagctatcatttgagtaaaagtatacatggagtaaaaatcatattaagcatcagattcaacttatattttctatttcatcttcttcctttcccttctcccaccttctactgggcataattatatcttaatcatatatggaaatgtgcaacatatggtatttgttaaatacgtttgtttttattgcagagcaaaaataaatcaaattagaagcaata

SEQ ID NO: 152917 - DNA, 1676 bp, Homo sapiens
  Payload ID: 10079
  Gene Symbol: MS4A4A
  Gene Name: membrane-spanning 4-domains, subfamily A, member 4A
  ENST ID: ENST00000343968
  CDS Start-End: 21-227
gaacttgcccagagccctgcatgcatcagacctacagcagacattgcaggcctgaagaaaggtggtcacaagaggggtggaacattcctgcaaatggtttcaatatatgcagatgtctcaatataggaatgaaattacgtctttggaacaacttaaataagtcaaatatacttggagctttaaaaattaaaaggagagagattcgagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctggtccgaggtagtctaggaatgaatatcaccagctctgtactggctgcatcagggatcttaatcaacacatttagcttggcgttttattcattccatcacccttactgtaactactatggcaactcaaataattgtcatgggactatgtccatcttaatgggtctggatggcatggtgctcctcctaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgaggccaccaaaagatcaacagacaaatgctccagaaatctatgctgactgtgacacaagagcctcacatgagaaattaccagtatccaacttcgatactgatagacttgttgatattattattatatgtaatccaattatgaactgtgtgtgtatagagagataataaattcaaaattatgttctcatttttttccctggaactcaataactcatttcactggctctttatcgagagtactagaagttaaattaataaataatgcatttaatgaggcaacagcacttgaaagtttttcattcatcataagaactttatataaaggcattacattggcaaataaggtttggaagcagaagagcaaaaaaaagatattgttaaaatgaggcctccatgcaaaacacatacttccctcccatttatttaactttttttttctcctacctatggggaccaaagtgctttttccttcaggaagtggagatgcatggccatctccccctccctttttccttctcctgcttttctttccccatagaaagtaccttgaagtagcacagcccgtccttgcatgtgcacgagctatcatttgagtaaaagtatacatggagtaaaaatcatattaagcatcagattcaacttatattttctatttcatcttcttcctttcccttctcccaccttctactgggcataattatatcttaatcatatatggaaatgtgcaacatatggtatttgttaaatacgtttgtttttattgcagagcaaaaataaatcaaattagaagc

SEQ ID NO: 152918 - DNA, 698 bp, Homo sapiens
  Payload ID: 10079
  Gene Symbol: MS4A4A
  Gene Name: membrane-spanning 4-domains, subfamily A, member 4A
  Uniprot ID: Q96JQ5
  ENST ID: ENST00000532114
  CDS Start-End: 136-696
attctcagcacagcctttaaggttccaaacatctgctagaagaggaatgcagatttaaactgagtgaggtgtggagtgggggaagttgattgggtctagaccaaagaactttgaggaacttgcccagagccctgcatgcatcagacctacagcagacattgcaggcctgaagaaagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctgggtctggatggcatggtgctcctcctaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgagg

SEQ ID NO: 152919 - DNA, 658 bp, Homo sapiens
  Payload ID: 10079
  Gene Symbol: MS4A4A
  Gene Name: membrane-spanning 4-domains, subfamily A, member 4A
  ENST ID: ENST00000529950
  CDS Start-End: 1-108
acctacagcagacattgcaggcctgaagaaaggcttgtatcaaggatatctacttccttctttatggactccaatggaggacttattcagagactgattgccttctaaatatgtgtctttttggtgatttctcctttactactgacttcgatgattctcagaactatacttttccagggaagtgacagttatcaactgatgtatttaattcccaggattataaacacaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctggtccgaggtagtctaggaatgaatatcaccagctctgtactggctgcatcagggatcttaatcaacacatttagcttggcgtttta

SEQ ID NO: 152920 - DNA, 851 bp, Homo sapiens
  Payload ID: 10079
  Gene Symbol: MS4A4A
  Gene Name: membrane-spanning 4-domains, subfamily A, member 4A
  ENST ID: ENST00000527056
  CDS Start-End: 8-214
gccctgcatgcatcagacctacagcagacattgcaggcctgaagaaaggtggtcacaagaggggtggaacattcctgcaaatggtttcaatatatgcagatgtctcaatataggaatgaaattacgtctttggaacaacttaaataagtcaaatatacttggagctttaaaaattaaaaggagagagattcgagcaccttttctgctgccatgacaaccatgcaaggaatggaacaggccatgccaggggctggccctggtgtgccccagctgggaaacatggctgtcatacattcacatctgtggaaaggattgcaagagaagttcttgaagggagaacccaaagtccttggggccacttctctgagctcatgagaaaaaaagagaaataattgtggtagaagtaacatcgtaggtatcagaaaagcacctctgggctggttctggcatactccttttaaccttgaaattattggcaatgatagacgtcgcgagagataatattggttgtgcagattctgactgccctgatgagccttagcatgggaataacaatgatgtgtatggcatctaatacttatggaagtaaccctatttccgtgtatatcgggtacacaatttgggggtcagtaatgtttattatttcaggatccttgtcaattgcagcaggaattagaactacaaaaggcctggtccgaggtagtctaggaatgaatatcaccagctctgtactggctgcatcagggatcttaatcaacacatttagcttggcgttttattcattccatcacccttactgtaactactatggcaactcaaataattgtcatgggactatgtccatcttaatg

SEQ ID NO: 152921 - DNA, 479 bp, Homo sapiens
  Payload ID: 10080
  Gene Symbol: MS4A4E
  Gene Name: membrane-spanning 4-domains, subfamily A, member 4E
  Uniprot ID: Q96PG1
  ENST ID: ENST00000398984
  CDS Start-End: 1-399
atgacaaccatgcaaggaatggaacagaccactccaggggctggccctgatgtgccccagctgggaaacatagatgtcatacattcatatctgtgtaaaggattgcaagagaagttcttcaagaggaaacccaaagtccttggggttgtgcggattctgattgccttgatgagccttagcatgggaataataatgatgtgtgttgcatttagttcttatgaagaacatcccatttttgtgtatgttgcgtacacaatttgggggtcagtgatgtatccttatcagttgcagcaggaattagaacaacaaaaggtctggaattatctgaagaatttaagctggagaataatgggatcatatttgtgttttggcgagagatcagagttgaaaccactataaggagacaagttagaagactattgaaataagataaaggttggaggtagtctaggaaagaatatcaccagttcagtcttggc

SEQ ID NO: 152922 - DNA, 522 bp, Homo sapiens
  Payload ID: 10080
  Gene Symbol: MS4A4E
  Gene Name: membrane-spanning 4-domains, subfamily A, member 4E
  ENST ID: ENST00000398986
  CDS Start-End: 17-520
caccttttctgctgccatgacaaccatgcaaggaatggaacagaccactccaggggctggccctgatgtgccccagctgggaaacatagatgtcatacattcatatctgtgtaaaggattgcaagagaagttcttcaagaggaaacccaaagtccttggggttgtgcggattctgattgccttgatgagccttagcatgggaataataatgatgtgtgttgcatttagttcttatgaagaacatcccatttttgtgtatgttgcgtacacaatttgggggtcagtgatgtttattatttcagtatccttatcagttgcagcaggaattagaacaacaaaaggtctgggtacggatggcatggtgctcctcttaagtgtgctggaattctgcattgctgtggccctctctgcctttggatgtaaagtgctttgttgtagccccagtgagtttgtgctaattacaccatcaaattctcacatggcagaaatagcatctcccacaccacttaagacagtttgatg

SEQ ID NO: 152923 - DNA, 350 bp, Homo sapiens
  Payload ID: 10080
  Gene Symbol: MS4A4E
  Gene Name: membrane-spanning 4-domains, subfamily A, member 4E
  Uniprot ID: Q96PG1
  ENST ID: ENST00000425663
  CDS Start-End: 1-270
atgacaaccatgcaaggaatggaacagaccactccaggggctggccctgatgtgccccagctgggaaacatagatgtcatacattcatatctgtgtaaaggattgcaagagaagttcttcaagaggaaacccaaagtccttgggtatccttatcagttgcagcaggaattagaacaacaaaaggtctggaattatctgaagaatttaagctggagaataatgggatcatatttgtgttttggcgagagatcagagttgaaaccactataaggagacaagttagaagactattgaaataagataaaggttggaggtagtctaggaaagaatatcaccagttcagtcttggc

SEQ ID NO: 152924 - DNA, 1125 bp, Homo sapiens
  Payload ID: 10080
  Gene Symbol: MS4A4E
  Gene Name: membrane-spanning 4-domains, subfamily A, member 4E
  ENST ID: ENST00000532442
  CDS Start-End: 148-360
agtgcagatttaaactgagtgaggtgtggagtgggggaagctgactgtgtctggaacaaagaactttgaggaacttgcccagagccctgcactcatcagacctgcagcagacattgcaggcctgaagaaagcaccttttctgctgccatgacaaccatgcaaggaatggaacagaccactccaggggctggccctgatgtgccccagctgggaaacatagatgtcatacattcatatctgtgtaaaggattgcaagagaagttcttcaagaggaaacccaaagtccttggggttttgtgtggacataagttttcaactcattcgggttgtgcggattctgattgccttgatgagccttagcatgggaataataatgatgtgtgttgcatttagttcttatgaagaacatcccatttttgtgtatgttgcgtacacaatttgggggtcagtgatgtatccttatcagttgcagcaggaattagaacaacaaaaggtctgtatttatcgagtgctcaatggtgcccaggctggagtgcagtggcgtgatctcggctccctacaacctccacctcccagccgcctgccttggcctcccaaagtgccgagagtgcagcctctgcccggccgccaccccgtctgggaagtgaggagcgtctctgcctggccgcctatcgtctgggacgtgaggagcccctctgcctggctgcccagtctggaaagtgaggagcgtctctgcccggctgccatcccatctaggaagtggggagcgcctcttcccggccaccatcccatctgggaggtgaggagtgtctccgcccggccgcccatcttctgagatgtggggagcgcctttgccccaccgccctgtctgggatgtgaggagcacctctgcccggccgcgaccccgtctgggaggtgaggagcgtctctgcccagccgccccatctgagaagggaggagaccctccgcctggcaaccgccccgtctgagaagtgaggagcccctccgcccggcagccaccccgtctgggaagtgaggagcgtctccgccaggcagccaccccgtccgggagggaggtgggggtcagcccccgccaggccagctgccccatccgggagggaggtg

SEQ ID NO: 152925 - DNA, 460 bp, Homo sapiens
  Payload ID: 10080
  Gene Symbol: MS4A4E
  Gene Name: membrane-spanning 4-domains, subfamily A, member 4E
  Uniprot ID: Q96PG1
  ENST ID: ENST00000526086
  CDS Start-End: 1-333
atgacaaccatgcaaggaatggaacagaccactccaggggctggccctgatgtgccccagctgggaaacatagatgtcatacattcatatctgtgtaaaggattgcaagagaagttcttcaagaggaaacccaaagtccttggggttttgtgtggacataagttttcaactcattcggtatccttatcagttgcagcaggaattagaacaacaaaaggtctggaattatctgaagaatttaagctggagaataatgggatcatatttgtgttttggcgagagatcagagttgaaaccactataaggagacaagttagaagactattgaaataagataaaggtagacagcagtgtaaagtaattaacagagatatatctgaggatgatgttggattgcttaattaattttcatttctttctaggttggaggtagtctaggaaagaatatcaccagttcagt

SEQ ID NO: 152926 - DNA, 384 bp, Homo sapiens
  Payload ID: 10080
  Gene Symbol: MS4A4E
  Gene Name: membrane-spanning 4-domains, subfamily A, member 4E
  ENST ID: ENST00000526153
  CDS Start-End: 1-202
gcaaggaatggaacagaccactccaggggctggccctgatgtgccccagctgggaaacatagatgtcatacattcatatctgtgtaaaggattgcaagagaagttcttcaagaggaaacccaaagtccttggggttttgtgtggacataagttttcaactcattcgggttgtgcggattctgattgccttgatgagccttagcatgggaataataatgatgtgtgttgcatttagttcttatgaagaacatcccatttttgtgtatgttgcgtacacaatttgggggtcagtgatgtatccttatcagttgcagcaggaattagaacaacaaaaggtctggttggaggtagtctaggaaagaatatcaccagttcagtcttggc

SEQ ID NO: 152927 - DNA, 555 bp, Homo sapiens
  Payload ID: 10080
  Gene Symbol: MS4A4E
  Gene Name: membrane-spanning 4-domains, subfamily A, member 4E
  Uniprot ID: Q96PG1
  ENST ID: ENST00000528394
  CDS Start-End: 1-399
atgacaaccatgcaaggaatggaacagaccactccaggggctggccctgatgtgccccagctgggaaacatagatgtcatacattcatatctgtgtaaaggattgcaagagaagttcttcaagaggaaacccaaagtccttggggttgtgcggattctgattgccttgatgagccttagcatgggaataataatgatgtgtgttgcatttagttcttatgaagaacatcccatttttgtgtatgttgcgtacacaatttgggggtcagtgatgtatccttatcagttgcagcaggaattagaacaacaaaaggtctggaattatctgaagaatttaagctggagaataatgggatcatatttgtgttttggcgagagatcagagttgaaaccactataaggagacaagttagaagactattgaaataagataaaggtagacagcagtgtaaagtaattaacagagatatatctgaggatgatgttggattgcttaattaattttcatttctttctaggttggaggtagtctaggaaagaatatcaccagttcagt

SEQ ID NO: 152928 - DNA, 722 bp, Homo sapiens
  Payload ID: 10081
  Gene Symbol: MS4A5
  Gene Name: membrane-spanning 4-domains, subfamily A, member 5
  Uniprot ID: Q9H3V2
  ENST ID: ENST00000300190
  CDS Start-End: 87-689
caggcagcctcagcacaagaaaagaacatggtctagactgaagtaccaactaaatcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttagggactatccagatcctgtttggaattatgaccttttcttttggagttatcttccttttcaccttgttaaaaccatatccaaggtttccctttatatttctttcaggatatccattctggggctctgttttgttcattaattctggagccttcctaattgcagtgaaaagaaaaaccacagaaactctgataatattgagccgaataatgaattttcttagtgccctgggagcaatagctggaatcattctcctcacatttggtttcatcctagatcaaaactacatttgtggttattctcaccaaaatagtcagtgtaaggctgttactgtcctgttcttgggaattttgattacattgatgactttcagcattattgaattattcatttctctgcctttctcaattttggggtgccactcagaggattgtgattgtgaacaatgttgttgactagcactgtgagaataaagatgtgttaaaata

SEQ ID NO: 152929 - DNA, 279 bp, Homo sapiens
  Payload ID: 10081
  Gene Symbol: MS4A5
  Gene Name: membrane-spanning 4-domains, subfamily A, member 5
  ENST ID: ENST00000528093
  CDS Start-End: 1-103
aactcaaagccccttgcaaaaattatttgctagaaaaatgaaaatcttaggggatatccattctggggctctgttttgttcattaattctggagccttcctaattgcagtgaaaagaaaaaccacagaaactctgggaattttgattacattgatgactttcagcattattgaattattcatttctctgcctttctcaattttggggtgccactcagaggattgtgattgtgaacaatgttgttgactagcactgtgagaataaagatgtgttaaaata

SEQ ID NO: 152930 - DNA, 403 bp, Homo sapiens
  Payload ID: 10081
  Gene Symbol: MS4A5
  Gene Name: membrane-spanning 4-domains, subfamily A, member 5
  ENST ID: ENST00000528905
  CDS Start-End: 1-370
actttcagccacgaccttttcaactcaaagccccttgcaaaaattatttgctagaaaaatgaaaatcttagggactatccagatcctgtttggaattatgaccttttcttttggagttatcttccttttcaccttgttaaaaccatatccaaggtttccctttatatttctttcaggatatccattctggggctctgttttgttcattaattctggagccttcctaattgcagtgaaaagaaaaaccacagaaactctgggaattttgattacattgatgactttcagcattattgaattattcatttctctgcctttctcaattttggggtgccactcagaggattgtgattgtgaacaatgttgttgactagcactgtgagaataaagatgtgttaaaata

SEQ ID NO: 152931 - DNA, 480 bp, Homo sapiens
  Payload ID: 10081
  Gene Symbol: MS4A5
  Gene Name: membrane-spanning 4-domains, subfamily A, member 5
  ENST ID: ENST00000531403
  CDS Start-End: 33-236
tcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttaggggatatccattctggggctctgttttgttcattaattctggagccttcctaattgcagtgaaaagaaaaaccacagaaactctgatcaaaactacatttgtggttattctcaccaaaatagtcagtgtaaggctgttactgtcctgttcttgggaattttgattacattgatgactttcagcattattgaattattcatttctctgcctttctcaattttggggtgccactcagaggattgtgattgtgaacaatgttgttgactagcactgtgagaataaagatgtgttaaaata

SEQ ID NO: 152932 - DNA, 584 bp, Homo sapiens
  Payload ID: 10081
  Gene Symbol: MS4A5
  Gene Name: membrane-spanning 4-domains, subfamily A, member 5
  ENST ID: ENST00000533885
  CDS Start-End: 71-415
aagaaaagaacatggtctagactgaagtaccaactaaatcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttagggactatccagatcctgtttggaattatgaccttttcttttggagttatcttccttttcaccttgttaaaaccatatccaaggtttccctttatatttctttcaggatatccattctggggctctgttttgttcattaattctggagccttcctaattgcagtgaaaagaaaaaccacagaaactctgaaataaatgaggggggaggagccaagatggccaaataggaacagctccggtctacagctcccagcgtgagagacgcagaagacgggtgatttctgcatttccatctgagtactgtgcttgatgaccctgcagctccagactagactaaaaagagaggggacacaagggaacttga

SEQ ID NO: 152933 - DNA, 1736 bp, Homo sapiens
  Payload ID: 10082
  Gene Symbol: MS4A6A
  Gene Name: membrane-spanning 4-domains, subfamily A, member 6A
  Uniprot ID: Q9H2W1
  ENST ID: ENST00000426738
  CDS Start-End: 474-1235
attccgaagggttctgtgctaggaaccttacacgtgttgtctcacataatccttaaaactcagaaatgattttaaattaaatagcacagagaggaaaactgactggagagggagcctttgcttaggtaggcaactttaactggtttattagcacattcccctgaagggaaagggggtgtgattgctcctgaagagaccaaagagactgggctcctttttaatcaaagctcaggaggagagctgcattccactgtttcacagatgctgtgagggtgacaaagatgcagggcacccactggaaacacagacggcactctgcgaaagaggaaggggcgccaggagcttggattagaaaactgaagcttcaagaacagacttgcctaacaacaggaaacttgtatgtctcgaagtggcaattcacacataaggctccatgactcctgaactctcacaaatattagttggctcttttcatggttttactgaagttgctagaagtttacagaaaaggaagtgcaggaacatttcacaaatctacaatctttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctggggtgagtgtgctggccggcttcacttaaccttgcctagtgtatcttatccctgcactgtgttgagtatgtcaccaagagtggtagaaggaacaatcagtcagtcatgagatacacatgggagggcatttgcattgtgatggaagacagagaagaaaagcagatggcaattgagtagctgataagctgaaaattcactggatatgaaaatagttaatcatgagaaatcaactgattcaatcttcctattttgtcagcgaagggaatgagactctgggaagttaaatgactggcctggcattatgctatgagtttgtgcctttgctgaggacactagaacctggcttgcctcccttataagcagaaacaatttctgccacaaccactagtctctttaatagtattgacttggtaaagggcatttacacacgtaactggatccagtgaatgtcttatgctctgcatttgcccctggtgatcttaaaattcgtttgcctttttaaagctatattaaaaatgtattgttgaatc

SEQ ID NO: 152934 - DNA, 863 bp, Homo sapiens
  Payload ID: 10082
  Gene Symbol: MS4A6A
  Gene Name: membrane-spanning 4-domains, subfamily A, member 6A
  Uniprot ID: Q9H2W1
  ENST ID: ENST00000420732
  CDS Start-End: 78-614
gagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtc

SEQ ID NO: 152935 - DNA, 1284 bp, Homo sapiens
  Payload ID: 10082
  Gene Symbol: MS4A6A
  Gene Name: membrane-spanning 4-domains, subfamily A, member 6A
  Uniprot ID: Q9H2W1
  ENST ID: ENST00000412309
  CDS Start-End: 19-780
tattagttggctcttttcatggttttactgaagttgctagaagtttacagaaaaggaagtgcaggaacatttcacaaatctacaatctttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctggggtgagtgtgctggccggcttcacttaaccttgcctagtgtatcttatccctgcactgtgttgagtatgtcaccaagagtggtagaaggaacaatcagtcagtcatgagatacacatgggagggcatttgcattgtgatggaagacagagaagaaaagcagatggcaattgagtagctgataagctgaaaattcactggatatgaaaatagttaatcatgagaaatcaactgattcaatcttcctattttgtcagcgaagggaatgagactctgggaagttaaatgactggcctggcattatgctatgagtttgtgcctttgctgaggacactagaacctggcttgcctcccttataagcagaaacaatttctgccacaaccactagtctctttaatagtattgacttggtaaagggcatttacacacgtaactggatccagtgaatgtcttatgctctgcatttgcccctggtgatcttaaaattcgtttgcctttttaaagctatattaaaaatgtattgttgaatcaaa

SEQ ID NO: 152936 - DNA, 1136 bp, Homo sapiens
  Payload ID: 10082
  Gene Symbol: MS4A6A
  Gene Name: membrane-spanning 4-domains, subfamily A, member 6A
  Uniprot ID: Q9H2W1
  ENST ID: ENST00000532169
  CDS Start-End: 515-940
cactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaagttgctagaagtttacagaaaaggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggacccttttttgtgagtagagtttctgaggagggcaggatggggcaaagaggggaggaagatgccaatagcttagacttcccacctgccagcttgctatgtttgatctgccaggagcaaggagtcaacggtgaatcttgttctcctgtcgggtaggatgacaggggttgcttgattttagatcaatttcttatcagactcaaataaacatttcttttgaagatcatcttattcttcacattatcatcttgagctatgatgaagctagtgacttctctccaggtttaggcgaaaaaaaaatccatgaattaggataaagttgggaaggaacattttatacaaaaaaaaaaaa

SEQ ID NO: 152937 - DNA, 1806 bp, Homo sapiens
  Payload ID: 10082
  Gene Symbol: MS4A6A
  Gene Name: membrane-spanning 4-domains, subfamily A, member 6A
  Uniprot ID: Q9H2W1
  ENST ID: ENST00000528851
  CDS Start-End: 142-819
ctggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctggggtgagtgtgctggccggcttcacttaaccttgcctagtgtatcttatccctgcactgtgttgagtatgtcaccaagagtggtagaaggaacaatcagtcagtcatgagatacacatgggagggcatttgcattgtgatggaagacagagaagaaaagcagatggcaattgagtagctgataagctgaaaattcactggatatgaaaatagttaatcatgagaaatcaactgattcaatcttcctattttgtcagcgaagggaatgagactctgggaagttaaatgactggcctggcattatgctatgagtttgtgcctttgctgaggacactagaacctggcttgcctcccttataagcagaaacaatttctgccacaaccactagtctctttaatagtattgacttggtaaagggcatttacacacgtaactggatccagtgaatgtcttatgctctgcatttgcccctggtgatcttaaaattcgtttgcctttttaaagctatattaaaaatgtattgttgaatcaaacccctatggacttatggctttatttaactgaattaaaaagccttgatttatccaaaattgtattatagagtgtagaatgaatactagggtgataaattgcaattatttgaagaacctggtgatatgctctacttatcttggattagctaagaattctatgtatacagttggaaaaatggcatatatacatctatcttgaacctgattgaagtctgaagacctaacatattttgtttcttctagagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtca

SEQ ID NO: 152938 - DNA, 567 bp, Homo sapiens
  Payload ID: 10082
  Gene Symbol: MS4A6A
  Gene Name: membrane-spanning 4-domains, subfamily A, member 6A
  ENST ID: ENST00000531531
  CDS Start-End: 337-567
cattcccctgaagggaaagggggtgtgattgctcctgaagagaccaaagagactgggctcctttttaatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggagattagaaaactgaagcttcaagaacagacttgcctaacaacaggaaacttgtatgtctcgaagtggcaattcacacataaggctccatgactcctgaactctcacaaatattagttggctcttttcatggttttactgaagttgctagaagtttacagaaaaggaagtgcaggaacatttcacaaatctacaatctttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattggg

SEQ ID NO: 152939 - DNA, 577 bp, Homo sapiens
  Payload ID: 10082
  Gene Symbol: MS4A6A
  Gene Name: membrane-spanning 4-domains, subfamily A, member 6A
  ENST ID: ENST00000534596
  CDS Start-End: 275-577
tccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaagttgctagaagtttacagaaaaggaagtgcaggaacatttcacaaatctacaatctttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctcca

SEQ ID NO: 152940 - DNA, 790 bp, Homo sapiens
  Payload ID: 10082
  Gene Symbol: MS4A6A
  Gene Name: membrane-spanning 4-domains, subfamily A, member 6A
  ENST ID: ENST00000527254
  CDS Start-End: 105-467
aggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggacccttttttagtatggtgatgaatttttgggtggtgatgatgagtttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctggg

SEQ ID NO: 152941 - DNA, 1160 bp, Homo sapiens
  Payload ID: 10082
  Gene Symbol: MS4A6A
  Gene Name: membrane-spanning 4-domains, subfamily A, member 6A
  ENST ID: ENST00000529054
  CDS Start-End: 219-1049
gtgttgtctcacataatccttaaaactcagaaatgattttaaattaaatagcacagagaggaaaactgactggagagggagcctttgcttagattagaaaactgaagcttcaagaacagacttgcctaacaacaggaaacttgtatgtctcgaagtggcaattcacacataaggctccatgactcctgaactctcacaaatattagttggctcttttcatggttttactgaagttgctagaagtttacagaaaaggaagtgcaggaacatttcacaaatctacaatctttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaa

SEQ ID NO: 152942 - DNA, 586 bp, Homo sapiens
  Payload ID: 10082
  Gene Symbol: MS4A6A
  Gene Name: membrane-spanning 4-domains, subfamily A, member 6A
  ENST ID: ENST00000533989
  CDS Start-End: 1-341
tctcccaagcagagaaacccgaacccaccaaccaggggcaggatagcctgaagaaacatctacacgcagaaatcaaagttattgggtttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcac

SEQ ID NO: 152943 - DNA, 780 bp, Homo sapiens
  Payload ID: 10082
  Gene Symbol: MS4A6A
  Gene Name: membrane-spanning 4-domains, subfamily A, member 6A
  ENST ID: ENST00000533023
  CDS Start-End: 69-413
gagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattggggtgcatagcagcctggttggaagcattctgagtgctctgtctgccctggtgggtttcattatcctgtctgtcaaacaggccaccttaaatcctgcctcactgcagtggaactctctctctgatgctgatttgcactctgctggaattctgcctagctgtgctcactgctgtgctgcggtggaaacaggcttactctgacttccctggggtgagtgtgctggccggcttcacttaaccttgcctagtgtatcttatccctgcactgtgttgagtatgtcaccaagagtggtagaaggaacaatcagtcagtcatgagatacacatgggagggcatttgcattgtgatggaagacagagaagaaaagcagatggcaattgagtagctgataagctgaaaattcactggatatgaaaatagttaatcatgagaaatcaactgattcaatcttcctattttgtcagcgaagggaatgagactctgggaagttaaatgactggcctggcattatgctatgagtttgtgcctttgctgaggacactagaacctggcttgcctcccttataa

SEQ ID NO: 152944 - DNA, 1383 bp, Homo sapiens
  Payload ID: 10082
  Gene Symbol: MS4A6A
  Gene Name: membrane-spanning 4-domains, subfamily A, member 6A
  Uniprot ID: Q9H2W1
  ENST ID: ENST00000530839
  CDS Start-End: 494-1240
attccgaagggttctgtgctaggaaccttacacgtgttgtctcacataatccttaaaactcagaaatgattttaaattaaatagcacagagaggaaaactgactggagagggagcctttgcttagattagaaaactgaagcttcaagaacagacttgcctaacaacaggaaacttgtatgtctcgaagtggcaattcacacataaggctccatgactcctgaactctcacaaatattagttggctcttttcatggttttactgaagttgctagaagtttacagaaaaggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtc

SEQ ID NO: 152945 - DNA, 682 bp, Homo sapiens
  Payload ID: 10082
  Gene Symbol: MS4A6A
  Gene Name: membrane-spanning 4-domains, subfamily A, member 6A
  ENST ID: ENST00000533409
  CDS Start-End: 614-682
gatacattgaagtcagcttccaaagaatgccacccaaggttttgaaggggcacagtgcctctgtcctcacaaaaccagcctgcatatgagtttactgaattcatttaggtcctgctgaatctttcccatttgttccttctctgtttcaatatttcaatgcttccctggaggggcccaacctttctggagggcaaagatctgttgttagagaaaaagagcagccagaggaggaagatgacttgaggattagaaaactgaagcttcaagaacagacttgcctaacaacaggaaacttgtatgtctcgaagtggcaattcacacataaggctccatgactcctgaactctcacaaatattagttggctcttttcatggttttactgaagttgctagaagtttacagaaaaggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaa

SEQ ID NO: 152946 - DNA, 711 bp, Homo sapiens
  Payload ID: 10083
  Gene Symbol: MS4A6E
  Gene Name: membrane-spanning 4-domains, subfamily A, member 6E
  Uniprot ID: Q96DS6
  ENST ID: ENST00000300182
  CDS Start-End: 66-509
aacttgggagctctgtacttttaagagctaaatctattttttcttccgtagttggcaacaccattatgacatcacaacctatttccaatgagaccatcataatgctcccatcaaatgtcatcaacttctcccaagcagagaaacccgaacccaccaaccaggggcaggatagcctgaagaaacgtctacaggcaaaagtcaaagttattggggtgcatagcagcctggctggaagcattctgagtgctctgtctgccctggtgggtttcattctcctgtctgtcaacccggctgcattaaatcctgcctcattgcagtgtaagttggacgaaaaggatataccaaccagacttcttctttcttatgattatcattcaccttacaccatggactgccatagagccaaagccagtctggctggaactctgtctctgatgctggtttctactgtgttggagttctgcctagctgtgctcactgctgtgctgcagtggaaacagactgtctgacttccctggttactcatgtcctcaaagacgactcatgatgctggatatgaagaactattgacttcttgggaaaaaacggagaaatattaattggaaagttgatttttatgataatatggaaaacctaaccattataaaaaagcaaacttgagtttcctaaatgtaagcatttaaagtaatgcatatttgttttaaaaaatta

SEQ ID NO: 152947 - DNA, 566 bp, Homo sapiens
  Payload ID: 10083
  Gene Symbol: MS4A6E
  Gene Name: membrane-spanning 4-domains, subfamily A, member 6E
  ENST ID: ENST00000532756
  CDS Start-End: 1-369
aaacccgaacccaccaaccaggggcaggatagcctgaagaaacgtctacaggcaaaagtcaaagttattggggtgcatagcagcctggctggaagcattctgagtgctctgtctgccctggtgggtttcattctcctgtctgtcaacccggctgcattaaatcctgcctcattgcagtgtaagttggacgaaaaggatataccaaccagacttcttctttcttatgattatcattcaccttacaccatggactgccatagagccaaagccagtctggctggaactctgtctctgatgctggtttctactgtgttggagttctgcctagctgtgctcactgctgtgctgcagtggaaacagactgtctgacttccctggttactcatgtcctcaaagacgactcatgatgctggatatgaagaactattgacttcttgggaaaaaacggagaaatattaattggaaagttgatttttatgataatatggaaaacctaaccattataaaaaagcaaacttgagtttcctaaatagttctgccatagaatcatggagtcaacatcccag

SEQ ID NO: 152948 - DNA, 483 bp, Homo sapiens
  Payload ID: 10083
  Gene Symbol: MS4A6E
  Gene Name: membrane-spanning 4-domains, subfamily A, member 6E
  ENST ID: ENST00000530509
  CDS Start-End: 1-180
gaacccaccaaccaggggcaggatagcctgaagaaacgtctacaggcaaaagtcaaagttattgggagtttattaaagaagctgtattgcatgaagggaggagagaaagaagggatctatcttggattgggagggaaacacagagttttggtttctagaattgcctctgcacttatgtgatctgaggtgcatagcagcctggctggaagcattctgagtgctctgtctgccctggtgggtttcattctcctgtctgtcaacccggctgcattaaatcctgcctcattgcagtctgaaagaagtgtgatatcttaaatcaggagataagaaatatagggagatggagagtgtaactgagaattatcgcaggagaattctctctctttggaagaagaaaaacaatgaagtttggctaacagaaataatgtgtctgaagttgaaaaattaaggggtatgtgcatggccagcaacgcattgagagga

SEQ ID NO: 152949 - DNA, 1869 bp, Homo sapiens
  Payload ID: 10084
  Gene Symbol: MS4A7
  Gene Name: membrane-spanning 4-domains, subfamily A, member 7
  Uniprot ID: Q9GZW8
  ENST ID: ENST00000300184
  CDS Start-End: 197-919
aaaattcacatcctgtgtaatcataaatactgctctaagaaagggacaggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgttttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcaataaatgttatcagccagtcttccaaaatggtcataaactttataaactgctttgggtaaactgagcagaaggtgatacacagaagggaaaatgtgcactcatgctagtgtgaatttggtaagttgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaat

SEQ ID NO: 152950 - DNA, 2871 bp, Homo sapiens
  Payload ID: 10084
  Gene Symbol: MS4A7
  Gene Name: membrane-spanning 4-domains, subfamily A, member 7
  Uniprot ID: Q9GZW8
  ENST ID: ENST00000358246
  CDS Start-End: 194-781
attcacatcctgtgtaatcataaatactgctctaagaaagggacaggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcaataaatgttatcagccagtcttccaaaatggtcataaactttataaactgctttgggtaaactgagcagaaggtgatacacagaagggaaaatgtgcactcatgctagtgtgaatttggtaagttgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattc

SEQ ID NO: 152951 - DNA, 268 bp, Homo sapiens
  Payload ID: 10084
  Gene Symbol: MS4A7
  Gene Name: membrane-spanning 4-domains, subfamily A, member 7
  ENST ID: ENST00000528215
  CDS Start-End: 151-268
atcgttctggcaggaacagccagtgggaggttccagctgagcgctccccagaggtgagctgatccccagccacagcacacaggaccaggctgcgagaacagctttacaccaaagggcatcactatccctcaaagagagaaacctggacacatgtaccaaaacgaagattacctgcagaacgggctgccaacagaaaccaccgttcttgggtttggcattactggatccctctcaattatctctggaaaacaatcaactaagccctttg

SEQ ID NO: 152952 - DNA, 730 bp, Homo sapiens
  Payload ID: 10084
  Gene Symbol: MS4A7
  Gene Name: membrane-spanning 4-domains, subfamily A, member 7
  ENST ID: ENST00000530234
  CDS Start-End: 140-436
agaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgtggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatgg

SEQ ID NO: 152953 - DNA, 657 bp, Homo sapiens
  Payload ID: 10084
  Gene Symbol: MS4A7
  Gene Name: membrane-spanning 4-domains, subfamily A, member 7
  ENST ID: ENST00000530614
  CDS Start-End: 151-657
caggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaac

SEQ ID NO: 152954 - DNA, 1378 bp, Homo sapiens
  Payload ID: 10084
  Gene Symbol: MS4A7
  Gene Name: membrane-spanning 4-domains, subfamily A, member 7
  Uniprot ID: Q9GZW8
  ENST ID: ENST00000534016
  CDS Start-End: 130-717
atcataaatactgctctaagaaagggacaggaagtctcagaggctggagagcagagcaccaagatcgttctggcaggaacagccagtgggaggttccagctgagcgctccccagagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcaataaatgttatcagccagtcttccaaaatggtcataaactttataaactgctttgggtaaactgagcagaaggtgatacacagaagggaaaatgtgcactcatgctagtgtgaatttggtaagttgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggct

SEQ ID NO: 152955 - DNA, 633 bp, Homo sapiens
  Payload ID: 10084
  Gene Symbol: MS4A7
  Gene Name: membrane-spanning 4-domains, subfamily A, member 7
  ENST ID: ENST00000530027
  CDS Start-End: 151-633
caggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttggggacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaa

SEQ ID NO: 152956 - DNA, 1353 bp, Homo sapiens
  Payload ID: 10085
  Gene Symbol: MS4A8
  Gene Name: membrane-spanning 4-domains, subfamily A, member 8
  Uniprot ID: Q9BY19
  ENST ID: ENST00000300226
  CDS Start-End: 204-956
aaacaggaaataaatacgaatgaaactgagctctaagcagcatgtaacctggcctgcatccaggaaatagaggacttcggatccttctaaccctaccacccaactggccccagtacattcattctctcaggaaaaaaaacaaggtccccacagcaaagaaaaggaataggatcaagagatacgtggctgctggcagagcaagcatgaattcgatgacttcagcagttccggtggccaattctgtgttggtggtggcaccccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggccatccagatcatcattggcctggctcacatcggcctcggctccatcatggcgacggttctcgtaggggaatacctgtctatttcattctacggaggctttcccttctggggaggcttgtggtttatcatttcaggatctctctccgtggcagcagaaaatcagccatattcttattgcctgctgtctggcagtttgggcttgaacatcgtcagtgcaatctgctctgcagttggagtcatactcttcatcacagatctaagtattccccacccatatgcctaccccgactattatccttacgcctggggtgtgaaccctggaatggcgatttctggcgtgctgctggtcttctgcctcctggagtttggcatcgcatgcgcatcttcccactttggctgccagttggtctgctgtcaatcaagcaatgtgagtgtcatctatccaaacatctatgcagcaaacccagtgatcaccccagaaccggtgacctcaccaccaagttattccagtgagatccaagcaaataagtaaggctacagattctggaagcatctttcactgggaccaaaagaagtcctcctccctttctgggcttccataacccaggtcgttcctgttctgacagctgaggaaacgtctctcccactgtttgtactctcaccttcattcttcaattcagtctaggaaaccatgctgtttctctatcaagaagaagacagagattttaaacagatgttaaccaagagggactccctagggcacatgcatcagcacatatgtgggcatccagcctctggggccttggcacacacacattcgtgtgctctgctgcatgtgagcttgtgggttagaggaacaaatatctagacattcaatcttcactctttcaattgtgcattcatttaataaatagatactgagcattcaa

SEQ ID NO: 152957 - DNA, 677 bp, Homo sapiens
  Payload ID: 10085
  Gene Symbol: MS4A8
  Gene Name: membrane-spanning 4-domains, subfamily A, member 8
  ENST ID: ENST00000525458
  CDS Start-End: 1-491
cccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggccatccagatcatcattggcctggctcacatcggcctcggctccatcatggcgacggttctcgtaggggaatacctgtctatttcattctacggaggctttcccttctggggaggcttgtggtttatcatttcaggatctctctccgtggcagcagaaaatcagccatattcttattgcctgctgtctggcagtttgggcttgaacatcgtcagtgcaatctgctctgcagttggagtcatactcttcatcacagatctaagtattccccacccatatgcctaccccgactattatccttacgcctggggtgtgttctgccaatgattgatcttggaatgagaactcgccccatgcccaccacccattccaccttcaagcctcagtcatcccatctgaacatggagggtcggactgcatctgagctttgcaaataatgacccaaggaatggagatactccggggtttccacatcaggaattatttttcatcaaataaaaaaaatctcagctg

SEQ ID NO: 152958 - DNA, 548 bp, Homo sapiens
  Payload ID: 10085
  Gene Symbol: MS4A8
  Gene Name: membrane-spanning 4-domains, subfamily A, member 8
  ENST ID: ENST00000532816
  CDS Start-End: 31-297
aagagatacgtggctgctggcagagcaagcatgaattcgatgacttcagcagttccggtggccaattctgtgttggtggtggcaccccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggcattttcggaaagagaaagaaaagcaacaaaaaagcagcacgcttgaaggttgatcctgttgccaggatccacgcccagccctgtggcctctgaagaaaggggtcccagcaagaccaaaatagaccacaaggtggagtcagaatccaataagatcgaatcaaatatttgcccaacaggaaacaaagcaggccatccagatcatcattggcctggctcacatcggcctcggctccatcatggcgacggttctcgtaggggaatacctgtctatttcattctacggaggctttcccttct

SEQ ID NO: 152959 - DNA, 746 bp, Homo sapiens
  Payload ID: 10085
  Gene Symbol: MS4A8
  Gene Name: membrane-spanning 4-domains, subfamily A, member 8
  ENST ID: ENST00000529752
  CDS Start-End: 75-746
ggaaaaaaaacaaggtccccacagcaaagaaaaggaataggatcaagagatacgtggctgctggcagagcaagcatgaattcgatgacttcagcagttccggtggccaattctgtgttggtggtggcaccccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggccatccagatcatcattggcctggctcacatcggcctcggctccatcatggcgacggttctcgtaggggaatacctgtctatttcattctacggaggctttcccttctggggaggcttgtggtttatcatttcaggatctctctccgtggcagcagaaaatcagccatattcttattgcctgctgtctggcagtttgggcttgaacatcgtcagtgcaatctgctctgcagttggagtcatactcttcatcacagatctaaaaccctggaatggcgatttctggcgtgctgctggtcttctgcctcctggagtttggcatcgcatgcgcatcttcccactttggctgccagttggtctgctgtcaatcaagcaatgtgagtgtcatctatccaaacatctatgcagcaaacccagtgatcaccccagaaccggtgacctcaccaccaagtta

SEQ ID NO: 152960 - DNA, 7556 bp, Homo sapiens
  Payload ID: 10086
  Gene Symbol: MN1
  Gene Name: meningioma (disrupted in balanced translocation) 1
  Uniprot ID: Q10571
  ENST ID: ENST00000302326
  CDS Start-End: 956-4918
gcgcggaggcagggaaccggagccttggagcgacccaacccctcgtctcgctgccctcccgcgcctgcaacggtgcgcggagactccggcgaactcagacacccaacggcggagaacagaagcggcaggcggcggacgtggccgcgaagctgcgcgccgaacgcagcgcacccgctgccgagcagaggagccgcgcctttccccgaccctcggctccagcccccggcgcctgccgcctcgcagcccctctgcgtcctcggctcgggggccggcaccggcgatgccgagcggagcctccagtcctccgacccgctgaagaagcagcagccgctcgcccggagcctacggggattgtgcgagcggatcgtgctcggtggaggctcgggctgcggggcgcggggactccggggggcggggggagggaccgctctgtcggtgcccggcgccagccgcggctttgaagggtctccctcccctgcccttagcagctctgccacggactccgggaggctgcgggcggcgtcctgagggctccccagcagacccaatcggacttgagaaggtgatcgctctgctctcccaacccccttccctccccattccccccacttaactttttgtctccgttcatccgcggcttcgtcccctccccgcagacccacccgcggctgtgacaaccgcccggggcatgggccccccaacacggctcctagaggccccgcggcctcgcaagatgtgagaggccctccccgggcagaatcggagcttcaggagaggagctaataccccgccccccgtccctcacatcaggcggggtggaggtgcgcgctgagcccccgcggtgctgagcgtcccggagcgcccaatcctgggctggaacgagtagctggccggaggcgcgccgcggagagccggctgtcatgccctattgatccccctctgccccccgccaagtatgtttgggctggaccaattcgagccccaggtcaacagcaggaacgctggccagggcgagaggaactttaacgagaccggactgagcatgaacacccactttaaggccccggctttccacactggggggccccctggccctgtggatcctgctatgagcgcgctgggcgaacccccgatcttgggcatgaacatggagccctacggcttccacgcgcgcggccactcggagttgcacgcaggggggctgcaagcgcagcctgtgcacggcttctttggcggccagcagcctcaccacggccacccgggaagtcatcatccccaccagcatcacccccactttgggggcaacttcggtggcccggaccccggggcctcgtgcctgcacgggggtcgcctgctcggctacggcggcgcagccggaggcctgggcagccagccgcccttcgccgagggctatgagcacatggcggagagccaggggcctgagagcttcggcccgcagcgaccggggaacctcccggacttccacagttcaggtgcctccagccacgccgtgccggccccatgcctgccgctggaccagagccctaaccgagccgcctccttccacggcctgccgtcctccagcggctccgattcccacagtctggagccacggagggtgacgaaccaaggagccgtcgactcgctggaatacaattacccgggcgaggcgccctcgggacattttgacatgttttcgccctctgactccgaagggcagctgcctcattatgcagcgggtcgccaggttcctgggggcgctttcccgggcgcctcggccatgcccagagctgcgggcatggtgggcttgtccaaaatgcacgcccagccaccgcagcagcagccccagcagcagcagcagccccagcagcagcagcagcagcatggtgtgttctttgagaggttcagtggggccagaaagatgcctgtgggtctggagccctcagtgggctccaggcacccgttaatgcagcctccccagcaggccccgccaccccctcagcagcagcccccgcagcagccgccacagcagcagccgccgccgccacccgggcttctagtccgacaaaattcgtgcccgcctgcgctccctcggccccagcagggcgaggcgggcacgcccagcggcggcctgcaggacggaggccccatgctgcccagccagcacgcgcaattcgagtatcccatccaccggctggagaaccggagcatgcacccttattccgagcctgttttcagcatgcagcatcctcctccgcagcaggcgcccaaccagcggctgcagcatttcgacgcgcccccctacatgaacgtggccaagaggccgcgcttcgactttccgggcagcgcgggagtggaccgctgcgcttcgtggaacggcagcatgcacaacggcgctctggataatcacctctccccttccgcctacccaggcctacccggcgagttcacaccgcctgtgcccgacagcttcccttcggggccgcccctgcagcatccggccccggaccaccagtccctgcaacagcagcagcagcagcagcagcagcagcaacagcagcagcagcagcagcaacagcaacagcaacagcagcagcagcagcagcgccaaaacgcggccctcatgattaagcagatggcgtcgcggaatcagcagcagcggctgcgccagcccaacctggctcagctaggccaccccggggacgtgggccagggcggcctggtgcatggcggcccggtgggcggcttggcccagccgaactttgagcgcgaaggcggcagcacgggcgccgggcgtctgggcaccttcgagcagcaggcgccgcacttggcgcaagagagcgcgtggttctcaggtccgcatccgccgcccggagacctgctgccccgtaggatgggcggctcgggtctgcccgctgactgtggcccgcacgaccccagcctggcgccccctcctccgcctggtggctcgggggtgctgttccggggccctctgcaggagccgatgaggatgcccggagagggccacgtgcccgcgctgccttcaccgggcctgcagttcgggggcagtctgggaggcctgggtcagctgcagtcgcccggggcgggcgtggggctccccagcgctgcttcggagcgccggcccccgccgccggactttgctacgtctgcgctcgggggccagccgggctttccgtttggtgcagccggccggcagtccacgccgcacagcggtccaggcgtgaactcgccccccagcgcgggagggggcggtggcagctctggtggcggcggtggcgggggtgcctacccgccgcagcctgatttccagcccagccagcgcacctcggccagtaaattgggcgcgctctcgctgggctccttcaacaagcccagctccaaggacaacctgttcggccagagctgcctggctgcgctctccaccgcttgccagaacatgatcgccagcctcggggcccccaacctcaacgtgaccttcaacaagaagaacccgccagagggcaagaggaaactgagccagaacgagaccgacggcgcggcagtggccggcaacccgggctcggattacttcccaggagggactgctcctggggccccaggacccggaggcccgtccgggaccagtagcagcggctccaaagcctcggggccgcccaaccctccagcccagggggacggcaccagcctctcccccaactacaccctggaatccacgtcggggaatgacggcaagccggtctccgggggcggcggccggggacggggtcgcagaaaaagggacagtggtcacgtgagccctggcaccttctttgacaagtactcggcggctccggacagcgggggcgcacctggggtgagcccagggcagcagcaagcgtcaggcgcagccgtcgggggaagctccgcaggcgagacgcgcggggcaccgacgccccacgaaaaggcgctcacgtcgccatcctgggggaagggggctgagttgctcctgggggatcagccggacctcattgggtccctggacggcggggccaagtcggacagtagttcgccaaacgtgggtgagttcgcctcggacgaggtgagcacgagctacgccaatgaggacgaggtgtcgtccagctctgacaacccccaggcactagttaaagcgagcaggagtcccctggtgaccggctcgcccaaactccctccccgtggggtaggcgccggggaacacggaccgaaggcgcccccgcccgccctcggcctgggcatcatgtctaactctacctcgacccctgacagctacggcggcggtgggggcccgggccatccgggcactccgggcctggagcaggtccgcaccccgacgagcagcagcggcgccccgccacccgacgagatccaccccctggagatccttcaggcgcagatccagctacagaggcagcagttcagcatctccgaggaccagcctctggggctgaagggtggcaagaagggtgagtgcgccgtcggggcctcaggggcgcagaatggcgacagcgagctgggcagctgctgctccgaggcggtcaagagcgccatgagcaccattgacctggactcgctgatggcagagcacagcgctgcctggtacatgcccgctgacaaggccctggtggacagcgcggacgacgacaagacgttggcgccctgggagaaggccaaaccccagaaccccaacagcaaagaagcccacgacctccctgcaaacaaggcctcagcatcccagcctggcagccacttgcagtgcctgtctgtccactgcacagacgacgtgggtgacgccaaggctcgagcctccgtgcccacctggcggtccctgcattctgacatctccaacagatttgggacattcgtggctgccctaacttgaatgacaagaaagatcccctcctctaccaggcccttcctctccccctgtctgtttccttccccctcaaccttaccccacccctctgttaatttgaaagggccactattgctgagtggatgagttttttttttttctctaggttggtacctgcttagtggcatatggaccggaaagggttaatttaaagggggggaacctcaaaagtttttttaaaaaagaaacttgtctgccacagtatgttaccagtgttaacccttctgcagttagcaaacttttgcttaagcctttttcctctagatactccccatgtttcggtaatcttggcatacattttttagatgacctctttccttgttttgttttcatgctgctgtatgtccaagtattgttatttcataataagacaagagttgctttcttttttattctttttccttttcttaccccctccccttttattttctttttgctttgttcactgcttattaaaatggaaatcctggagaatagtagttctggaatattgccgggtgaaagtccaattgtcatcacaatgttatatattgacaccccagtgtcatcagtcaggcaggagccaaacaatgaatgcccctcttaggtattccgcctgggattttgttttgtctgttccctaagaaaatatattttcattcctgcaaacacagtgctcagccttcagttcccttccacttgagttctctcttctcctgctggaagccgcccctctctgcgatggacgtgaggacgtgtccagctctgctctgtgggaaggagttggaatgttcgacagcagtgttttctctccttttctgggcctcctcgcaaatgcccaggccctgcattttcacgctgtgctaagcagcctttggtctgcatgggggatggtgtgctcccagcctgcagtctttggagcaaggctgctgcccgtgccttgggtgctggagttggaggaggctgttctcagccctttcccttttctgaaagctgttcctggccgggcatcccagggaagaaggaggggactgcgtgtatctcctccacctctcccattccatccccagtccagcctgggcaaccccacccctgggagggatgaggcaccctcttgctcagcctgctcagccttctctgagcctttgcagggatctgcagactcctgagggctagaggacagagaaagagaatagaatgaaatgactttgattcctgcgccttttagttttgaactctggaattcctctgccccctccccaacatttttttggaatctcaccctgttgcaaaactagagccatgtcccaagcatctcacaaaggaataactgctctgagcagagatgagtggtggttggcaggggcaggcaactttgggtgctgctgatgcctgcaaaagccatttatggcttgtggtggggggcacatagattccccggtgggttagacaggaagtaactgatatcacttcacccaaatatataaccgtgatggttatctatttaatttcagtttttgttaacgagcgtgtcttactaaaacgctccactttgagctcccccaccccctccaggtcctcagagtttgcagatctgggctttctaaagcaagtgacctgaaggctctgggctcaccatacaacacccacgttgtttatttcaaagaacttttcagcgaagggagaggagctttcagaaaaacctcactctttcccctcccttctcccctctttccttctgccggtccttttggctggggtctgagtctgcggttctcgcctgggcagtcttgacgaggagcaaaccccgccttcagagggcagacaaagcaggtggcatgaattgatcagcgagaaaggtgtgagccgaggcagttcctgcgttctgctacaaaaggaatggaaagggaagggaatttccccccaccatgggctgtgggagagttgaccgtattctgggcaagactccatgacccctctgattctgcagtgtacagctgtttgagagcctcatcattttacttttgaaacaggaatgatttctccttaattgcttaaggccggggagcaaagtgtcttaacttctgtctttgactttcccagcgttgagtcatcaacactttgccaattagctcatggtcctggcaacctcagaaacccctgaagttttaaaaactttctcgctccccacgaccccagaatgaaacagctttaaaaatagccttaagcaaaaggatgttatttcattaaatttggtttaatggaaagaataaaagtaaatgaaaaacacaccctacacactagactccgaacactggtaatcagtactgcatagcaaactctttgggaaagaaaacgaaaatgttattgcacatgtaaaatatgaaaacttaactctgctgtgtgttaggcaatcctgtaatcttttttgactcttaaaagaaattcatttctgaaatgcttggttggaagactgtgacaatagctcatgaaattgagtgttatttttttctttcttttttaaaaaaatatgtaaagtgcagtcttctgtattcctgcatattgtatatacctgtatatgttttcctgagcagttaaataacaataaatatgacgttaatggtga

SEQ ID NO: 152961 - DNA, 620 bp, Homo sapiens
  Payload ID: 10086
  Gene Symbol: MN1
  Gene Name: meningioma (disrupted in balanced translocation) 1
  ENST ID: ENST00000424656
  CDS Start-End: 1-316
ggactcgctgatggcagagcacagcgctgcctggtacatgcccgctgacaaggccctggtggacagcgcggacgacgacaagacgttggcgccctgggagaaggccaaaccccagaaccccaacagcaaagaagcccacgacctccctgcaaacaaggcctcagcatcccagcctggcagccacttgcagtgcctgtctgtccactgcacagacgacgtgggtgacgccaaggctcgagcctccgtgcccacctggcggtccctgcattctgacatctccaacagatttgggacattcgtggctgccctaacttgaatgacaagaaagatcccctcctctaccaggcccttcctctccccctgtctgtttccttccccctcaaccttaccccacccctctgttaatttgaaagggccactattgctgagtggatgagttttttttttttctctagtgctcagccttcagttcccttccacttgagttctctcttctcctgctggaagccgcccctctctgcgatggacgtgaggacgtgtccagctctgctctgtgggaaggagttggaatgttcgacagcagtgttttctctccttttctgggcctcctcgcaaatgcc

SEQ ID NO: 152962 - DNA, 3263 bp, Homo sapiens
  Payload ID: 10087
  Gene Symbol: MGEA5
  Gene Name: meningioma expressed antigen 5 (hyaluronidase)
  Uniprot ID: O60502
  ENST ID: ENST00000357797
  CDS Start-End: 397-2946
aggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttaggcttctggcgccccagcttaaagccgaggctgcggctgacaaagggctcgcgccggtgccgccgcccttctcatccgggcattcgggtccctgcggagagggagggggaagggcagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgca

SEQ ID NO: 152963 - DNA, 5155 bp, Homo sapiens
  Payload ID: 10087
  Gene Symbol: MGEA5
  Gene Name: meningioma expressed antigen 5 (hyaluronidase)
  Uniprot ID: O60502
  ENST ID: ENST00000361464
  CDS Start-End: 397-3147
aggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttaggcttctggcgccccagcttaaagccgaggctgcggctgacaaagggctcgcgccggtgccgccgcccttctcatccgggcattcgggtccctgcggagagggagggggaagggcagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaatgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgcttgt

SEQ ID NO: 152964 - DNA, 3314 bp, Homo sapiens
  Payload ID: 10087
  Gene Symbol: MGEA5
  Gene Name: meningioma expressed antigen 5 (hyaluronidase)
  Uniprot ID: O60502
  ENST ID: ENST00000370094
  CDS Start-End: 397-2430
aggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttaggcttctggcgccccagcttaaagccgaggctgcggctgacaaagggctcgcgccggtgccgccgcccttctcatccgggcattcgggtccctgcggagagggagggggaagggcagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgactgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttaggtaggtgcaccaggaataatctcttctcctcaaatatattgtccctttaaaaaaaattatcccacagggagaaaaacatttagggaattggcacatttccaagtctcttcaattcgttgcctaggtttctttcaaaaataggcattattgaagacttgagatgcaagtcttagtaaatacatcaagcacattaatttttctcccttgggctaattcagcataagtatcttaaaagtatgttagaaagtactgactttaacttgctctgactgaatgctttctggatggaaccctgtataccacttttatctgatttggagatgagacactatgaaatgtgactccacaagctttctgctgcttgctgtgtcttgataacattaatgctatgtttaacagaacaattgctgaaatgacctaaagggcctggcaagaggaagccatcctcccagccctgtgcgcatgcgagctttagtgtaaggctattctggtgctattcagtattatttcacgtggctttttctttatccttctaccaagtattggttttaccaggggatagaaattgtaatcccctaaacatctctgctacattaaatggacttttgtatgtctcctttgaacactgattttttttttttaaattgtcaaacttggtaaaaagcaccagcatggccaagtttctctagggacttcatttcattttcaggttttcaatccagctataaggaatatgtaatggacttatatacagcacacagcaggcagcaaggctgactgacatgtcatagttttcatagtagtcacaaatactatgatgggtttcatggtcttggttgtgaaatagatatctgaaacaccgtgagcttagaataaaaagtagtagtgagattttccactttctgcctgtatacctttgagctcttaaatattt

SEQ ID NO: 152965 - DNA, 5043 bp, Homo sapiens
  Payload ID: 10087
  Gene Symbol: MGEA5
  Gene Name: meningioma expressed antigen 5 (hyaluronidase)
  Uniprot ID: O60502
  ENST ID: ENST00000439817
  CDS Start-End: 444-3035
ggtctgcagcgcaagcgcagtgcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttaggcttctggcgccccagcttaaagccgaggctgcggctgacaaagggctcgcgccggtgccgccgcccttctcatccgggcattcgggtccctgcggagagggagggggaagggcagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacagaatactgtggcactttctgttatccaaatgtgtctcagtctccatatttaaggactgtgggtgaaaagcttctacctggaattgaagtgctttggacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgagtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaaattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttagggtgtcgtagtcattcttcagcacaattcttaattggagaccaagaaccctgggcctttagaggtggtctagcaggagagttccagcgtttgctgccaattgatggggcaaatgatctcttttttcagccacctccactgactcctacctccaaagtttatactatcagaccttattttcctaaggatgaggcatccgtgtacaagatttgcagagaaatgtatgacgatggagtgggtttaccctttcaaagtcagcctgatcttattggagacaagttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaatgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgcttgt

SEQ ID NO: 152966 - DNA, 769 bp, Homo sapiens
  Payload ID: 10087
  Gene Symbol: MGEA5
  Gene Name: meningioma expressed antigen 5 (hyaluronidase)
  ENST ID: ENST00000429860
  CDS Start-End: 1-769
gctgcaggaggggctcggcggttcctctgcggtgtggtggaaggattttatggaagaccttgggttatggaacagagaaaagaactctttagaaggctccagaaatgggaattaaatacatacttgtatgccccaaaagatgactacaaacataggatgttttggcgagagatgtattcagtggaggaagctgagcaacttatgactctcatctctgctgcacgagaatatgagatagagttcatctatgcgatctcacctggattggatatcactttttctaaccccaaggaagtatccacattgaaacgtaaattggaccaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaag

SEQ ID NO: 152967 - DNA, 2892 bp, Homo sapiens
  Payload ID: 10088
  Gene Symbol: MEP1A
  Gene Name: meprin A, alpha (PABA peptide hydrolase)
  Uniprot ID: Q16819
  ENST ID: ENST00000230588
  CDS Start-End: 10-2250
cttgcagcaatggcttggattagatccacttgcattctcttttttaccttgctttttgcccacatagcagctgtaccgattaagtatcttcctgaagaaaatgtacatgatgcagattttggtgaacagaaggatatttcagaaatcaatttagctgcaggcttggacctctttcaaggggacatcctcttgcagaaatccagaaatggcctgagagacccaaacaccaggtggacgttccccattccttacatcttggctgataatttggggctgaatgctaaaggagccattctgtatgcctttgagatgttccgtctcaagtcctgtgtggatttcaagccctatgaaggagagagctcatatatcatatttcaacagtttgatgggtgctggtctgaggttggtgaccaacatgtgggacagaacatttccattggccaaggatgtgcctataaggccatcatagaacacgagatcctgcatgctttgggattttaccacgagcagtcaaggacggaccgggatgattatgtgaacatctggtgggaccaaattctttcaggttaccagcacaactttgacacctatgatgatagcttaatcacagacctcaatacaccctatgattatgagtctttgatgcactaccagcctttctcatttaacaagaatgcaagtgttcccaccatcacagccaagatccctgagtttaactccattatcggacagcgcctggatttcagtgccattgatttagagaggctgaaccgaatgtacaattgcaccacaactcacactcttttggaccactgtacttttgagaaggcaaacatctgtggaatgattcagggcaccagagatgacactgactgggcccatcaggacagtgctcaggctggagaagtggatcacaccttgttgggacaatgcacaggtgccggctacttcatgcagttcagcaccagctcggggtccgcggaagaggcagccctactggagtctcggattctttacccaaagaggaagcagcagtgcctgcaatttttctataaaatgacgggaagtccttcagacagactcgttgtctgggtcaggagggatgacagcacaggcaatgttcgcaagttggtgaaggtgcagacttttcaaggagatgatgaccacaattggaaaattgcccatgtggtgctcaaagaggaacagaagtttcgctaccttttccagggcacaaaaggcgaccctcagaactcaactgggggaatttacctagatgacatcactctgacagaaaccccctgccccacaggggtctggacagtccggaatttctcccaagtccttgagaacaccagcaaaggggacaagcttcagagccctcgattctacaattcggagggatatggttttggggtaactttatacccaaatagcagagaaagctctggttacttgagacttgcttttcatgtgtgcagtggggagaacgatgctatcctggagtggccggtagaaaacagacaggtgataattaccatccttgaccaggagcctgatgtccggaacaggatgtcctcaagcatggtgttcactacctcgaagtcgcacacatctccagcgataaatgacactgtcatctgggacaggccgtccagggtgggaacctatcatacggactgtaattgttttagaagcatcgacttgggctggagtggtttcatttcccaccaaatgctgaaaaggaggagtttcctgaaaaatgatgacctcatcatatttgtggactttgaagatatcacccacctcagccagactgaagttcccactaaaggcaaaagactgagcccccaaggcctcattctccaaggccaggagcagcaggtctccgaagaaggttcgggaaaggccatgttagaggaagccctacctgtcagcctgagccaggggcagcccagccgacagaagcggtcggtggagaacacaggccccctggaggaccataactggccacagtacttcagagacccatgtgacccaaacccttgccaaaatgacggcatctgtgtgaacgtgaaggggatggcgagctgcaggtgcatctctggacatgctttcttctacacgggggagcgctgtcaggccgtgcaggtgcacggcagtgtcctgggcatggtgatcggaggcacggctggcgtgatcttcttgaccttctccatcatcgccatcctttcccaaaggccaaggaagtgacctgcctgctggcattggccagaccacagcagcacctcctccatgcaggccttaactttcccatggtcaatgcagtttttatcagccttgctttggataggacctccaaggactaaggcctccagccccatgtgtgacccttgtcatctctctgccccacataattctgttactttgctatgtgctcctaatgtatctagtgtgtcctgtgacaacactcatcacacttcattgtaaatcacttgttttattgactgtctttcctatagactgtaagctccatgagggcaggcacatgttgttctcattgaccgtgctggccccagtgcctagatgcatggctggcacattgttggcactcaacaatggttgaatgaataaaacaataaatgaatgaataactaagatatagaaactctcatttatattgcagattgaatatatatgatgaaattcttatgttgaatatgttagaatcaaatactcatttttcattagatacagtagtgtcatcactcttttaagatcttgttaaagatttcaaataaaggtacttctgggcagccaggctgcacagcatttgctttcctctgagattctaagagaaggcctttaataaatttaataaatattgagttagca

SEQ ID NO: 152968 - DNA, 2971 bp, Homo sapiens
  Payload ID: 10088
  Gene Symbol: MEP1A
  Gene Name: meprin A, alpha (PABA peptide hydrolase)
  ENST ID: ENST00000611727
  CDS Start-End: 1-2325
atggcttggattagatccacttgcattctcttttttaccttgctttttgcccacatagcagctgtaccggtaagtcgagtcctgctttttggatatttagaaatattaattctagtatacattatccattttctgtatatttatttttttcagattaagtatcttcctgaagaaaatgtacatgatgcagattttggtgaacagaaggatatttcagaaatcaatttagctgcaggcttggacctctttcaaggggacatcctcttgcagaaatccagaaatggcctgagagacccaaacaccaggtggacgttccccattccttacatcttggctgataatttggggctgaatgctaaaggagccattctgtatgcctttgagatgttccgtctcaagtcctgtgtggatttcaagccctatgaaggagagagctcatatatcatatttcaacagtttgatgggtgctggtctgaggttggtgaccaacatgtgggacagaacatttccattggccaaggatgtgcctataaggccatcatagaacacgagatcctgcatgctttgggattttaccacgagcagtcaaggacggaccgggatgattatgtgaacatctggtgggaccaaattctttcaggttaccagcacaactttgacacctatgatgatagcttaatcacagacctcaatacaccctatgattatgagtctttgatgcactaccagcctttctcatttaacaagaatgcaagtgttcccaccatcacagccaagatccctgagtttaactccattatcggacagcgcctggatttcagtgccattgatttagagaggctgaaccgaatgtacaattgcaccacaactcacactcttttggaccactgtacttttgagaaggcaaacatctgtggaatgattcagggcaccagagatgacactgactgggcccatcaggacagtgctcaggctggagaagtggatcacaccttgttgggacaatgcacaggtgccggctacttcatgcagttcagcaccagctcggggtccgcggaagaggcagccctactggagtctcggattctttacccaaagaggaagcagcagtgcctgcaatttttctataaaatgacgggaagtccttcagacagactcgttgtctgggtcaggagggatgacagcacaggcaatgttcgcaagttggtgaaggtgcagacttttcaaggagatgatgaccacaattggaaaattgcccatgtggtgctcaaagaggaacagaagtttcgctaccttttccagggcacaaaaggcgaccctcagaactcaactgggggaatttacctagatgacatcactctgacagaaaccccctgccccacaggggtctggacagtccggaatttctcccaagtccttgagaacaccagcaaaggggacaagcttcagagccctcgattctacaattcggagggatatggttttggggtaactttatacccaaatagcagagaaagctctggttacttgagacttgcttttcatgtgtgcagtggggagaacgatgctatcctggagtggccggtagaaaacagacaggtgataattaccatccttgaccaggagcctgatgtccggaacaggatgtcctcaagcatggtgttcactacctcgaagtcgcacacatctccagcgataaatgacactgtcatctgggacaggccgtccagggtgggaacctatcatacggactgtaattgttttagaagcatcgacttgggctggagtggtttcatttcccaccaaatgctgaaaaggaggagtttcctgaaaaatgatgacctcatcatatttgtggactttgaagatatcacccacctcagccagactgaagttcccactaaaggcaaaagactgagcccccaaggcctcattctccaaggccaggagcagcaggtctccgaagaaggttcgggaaaggccatgttagaggaagccctacctgtcagcctgagccaggggcagcccagccgacagaagcggtcggtggagaacacaggccccctggaggaccataactggccacagtacttcagagacccatgtgacccaaacccttgccaaaatgacggcatctgtgtgaacgtgaaggggatggcgagctgcaggtgcatctctggacatgctttcttctacacgggggagcgctgtcaggccgtgcaggtgcacggcagtgtcctgggcatggtgatcggaggcacggctggcgtgatcttcttgaccttctccatcatcgccatcctttcccaaaggccaaggaagtgacctgcctgctggcattggccagaccacagcagcacctcctccatgcaggccttaactttcccatggtcaatgcagtttttatcagccttgctttggataggacctccaaggactaaggcctccagccccatgtgtgacccttgtcatctctctgccccacataattctgttactttgctatgtgctcctaatgtatctagtgtgtcctgtgacaacactcatcacacttcattgtaaatcacttgttttattgactgtctttcctatagactgtaagctccatgagggcaggcacatgttgttctcattgaccgtgctggccccagtgcctagatgcatggctggcacattgttggcactcaacaatggttgaatgaataaaacaataaatgaatgaataactaagatatagaaactctcatttatattgcagattgaatatatatgatgaaattcttatgttgaatatgttagaatcaaatactcatttttcattagatacagtagtgtcatcactcttttaagatcttgttaaagatttcaaataaaggtacttctgggcagccaggctgcacagcatttgctttcctctgagattctaagagaaggcctttaataaatttaataaatattgagttagcacctt

SEQ ID NO: 152969 - DNA, 2312 bp, Homo sapiens
  Payload ID: 10089
  Gene Symbol: MEP1B
  Gene Name: meprin A, beta
  Uniprot ID: Q16820
  ENST ID: ENST00000269202
  CDS Start-End: 48-2153
tcaaccctgaatgtcatagttagctactttcaactggaagctacaacatggatttatggaatctgtcttggtttctgttcttggatgctcttctcgtgatttctggcttggcaactccagaaaactttgatgtagatggcggaatggaccaggacatatttgatatcaatgaaggtttgggactggatctttttgagggtgacatcagacttgatagggcacaaattagaaattccatcattggagaaaagtatagatggcctcataccattccatatgttctagaagatagcttggaaatgaatgctaagggagttatcctcaatgcatttgaacgttatcgccttaaaacatgtattgactttaagccttgggctggagaaacaaactatatatcagtgttcaagggcagtggctgctggtcttcagtaggaaataggcgggttgggaagcaagaactttccatcggggcaaactgtgaccgaatagcaacagttcaacacgagttcctccacgctctgggattctggcatgagcagtcgcgttctgaccgggatgactatgtcaggataatgtgggacagaattctgtcaggcagagagcacaattttaacacctatagtgacgatatatcagattccctgaatgttccctatgattacacttcagtaatgcactacagtaaaactgcattccaaaatggaacagagccgacaattgtcacaagaatctcagactttgaggatgtgatcggccaacgaatggatttcagtgactctgatctcctaaagttgaatcaactgtataactgctcctcttccttgagttttatggactcgtgcagttttgaactggaaaatgtgtgtggcatgatccaaagttcaggagataatgctgactggcaacgggtttcacaggttcccagggggccagagagtgatcactccaacatgggccagtgccaaggttctggtttcttcatgcatttcgatagcagctctgtaaatgtgggggccacagcagtgctggaaagtagaacgctgtaccctaaaagaggatttcagtgcctgcaattttacttatataacagtggcagtgaaagtgatcaactgaacatctatatcagggagtattctgcagacaatgtggatggcaatttaacccttgtggaagaaataaaagaaatacccactgggagctggcaactttatcatgtaacattgaaagtgaccaagaagtttagagtggtgtttgaaggacgcaaaggctctggtgcatcactgggtggtctgtctattgatgacatcaatctttcggaaacacggtgccctcatcatatctggcatataaggaatttcacacagttcattggcagcccaaatggaactctgtatagccctccattttactcttctaaaggttatgcctttcagatttacttaaatctagcccatgtgactaatgcagggatatatttccacttgatctctggagccaatgatgatcaattacagtggccatgtccttggcaacaagccacaatgacacttttggatcaaaatcctgacattcgacagcgtatgtccaatcagcggagtataactacagacccatttatgaccaccgataatggaaactatttctgggacaggccttctaaagtgggaacagtggctttgttctctaatggaactcagtttagaagaggtgggggctatggaaccagtgcctttataacccacgaaaggctgaaaagcagagattttataaaaggagatgatgtttatatcctactgacagtggaagacatatctcacctcaactctacacaaatccagctaacaccagcccctagtgttcaagacctctgctcaaaaaccacctgtaaaaatgacggtgtctgcactgttcgagatggcaaagctgagtgcaggtgccagtcaggggaagactggtggtacatgggagaaaggtgtgaaaagagaggctccacccgagacaccatagtcattgctgtttcatctactgttgctgtgtttgccttgatgctgatcatcacccttgtcagtgtctattgcaccaggaagaaatatcgtgaaaggatgagctcaaatcgaccaaatttgactccgcaaaatcagcatgctttttgaagattaactcgacaatatggccagctaatgaaattaaaaaggattcttcatcatggatttcgcctaagtgatattacagccacctcattcttctaaaagtggatatttttctgtaaatagctggaaatattataaatcactattttggtcaaagtcaaa

SEQ ID NO: 152970 - DNA, 483 bp, Homo sapiens
  Payload ID: 10089
  Gene Symbol: MEP1B
  Gene Name: meprin A, beta
  ENST ID: ENST00000581184
  CDS Start-End: 142-483
gaagaagcgaactgccatggtactgtagctgcaacatcaactcctgcctgggtctttagcctgctggcctaccctgcagattttggacttgccagcctccacaatcatgcaactccagaaaactttgatgtagatggcggaatggaccaggacatatttgatatcaatgaaggtttgggactggatctttttgagggtgacatcagacttgatagggcacaaattagaaattccatcattggagaaaagtatagatggcctcataccattccatatgttctagaagatagcttggaaatgaatgctaagggagttatcctcaatgcatttgaacgttatcgccttaaaacatgtattgactttaagccttgggctggagaaacaaactatatatcagtgttcaagggcagtggctgctggtcttcagtaggaaataggcgggttgggaagcaagaactttccatcggggcaaactgtgaccga

SEQ ID NO: 152971 - DNA, 2308 bp, Homo sapiens
  Payload ID: 10089
  Gene Symbol: MEP1B
  Gene Name: meprin A, beta
  ENST ID: ENST00000581447
  CDS Start-End: 47-2149
caaccctgaatgtcatagttagctactttcaactggaagctacaacatggatttatggaatctgtcttggtttctgttcttggatgctcttctcgtgatttctggcttggcaactccagaaaactttgatgtagatggcggaatggaccaggacatatttgatatcaatgaaggtttgggactggatctttttgagggtgacatcagacttgatagggcacaaattagaaattccatcattggagaaaagtatagatggcctcataccattccatatgttctagaagatagcttggaaatgaatgctaagggagttatcctcaatgcatttgaacgttatcgccttaaaacatgtattgactttaagccttgggctggagaaacaaactatatatcagtgttcaagggcagtggctgctggtcttcagtaggaaataggcgggttgggaagcaagaactttccatcggggcaaactgtgaccgaatagcaacagttcaacacgagttcctccacgctctgggattctggcatgagcagtcgcgttctgaccgggatgactatgtcaggataatgtgggacagaattctgtcaggcagagagcacaattttaacacctatagtgacgatatatcagattccctgaatgttccctatgattacacttcagtaatgcactacagtaaaactgcattccaaaatggaacagagccgacaattgtcacaagaatctcagactttgaggatgtgatcggccaacgaatggatttcagtgactctgatctcctaaagttgaatcaactgtataactgctcctcttccttgagttttatggactcgtgcagttttgaactggaaaatgtgtgtggcatgatccaaagttcaggagataatgctgactggcaacgggtttcacaggttcccagggggccagagagtgatcactccaacatgggccagtgccaaggttctggtttcttcatgcatttcgatagcagctctgtaaatgtgggggccacagcagtgctggaaagtagaacgctgtaccctaaaagaggatttcagtgcctgcaattttacttatataacagtggcagtgaaagtgatcaactgaacatctatatcagggagtattctgcagacaatgtggatggcaatttaacccttgtggaagaaataaaagaaatacccactgggagctggcaactttatcatgtaacattgaaagtgaccaagaagtttagagtggtgtttgaaggacgcaaaggctctggtgcatcactgggtggtctgtctattgatgacatcaatctttcggaaacacggtgccctcatcatatctggcatataaggaatttcacacagttcattggcagcccaaatggaactctgtatagccctccattttactcttctaaaggttatgcctttcagatttacttaaatctagcccatgtgactaatgcagggatatatttccacttgatctctggagccaatgatgatcaattacagtggccatgtccttggcaacaagccacaatgacacttttggatcaaaatcctgacattcgacagcgtatgtccaatcagcggagtataactacagacccatttatgaccaccgataatggaaactatttctgggacaggccttctaaagtgggaacagtggctttgttctctaatggaactcagtttagaagaggtgggggctatggaaccagtgcctttataacccacgaaaggctgaaaagcagagattttataaaaggagatgatgtttatatcctactgacagtggaagacatatctcacctcaactctacacaaatccagctaacaccagcccctagtgttcaagacctctgctcaaaaaccacctgtaaaaatgacggtgtctgcactgttcgagatggcaaagctgagtgcaggtgccagtcaggggaagactggtggtacatgggagaaaggtgtgaaaagagaggctccacccgagacaccatagtcattgctgtttcatctactgttgctgtgtttgccttgatgctgatcatcacccttgtcagtgtctattgcaccaggaagaaatatcgtgaaaggatgagctcaaatcgaccaaatttgactccgcaaaatcatgctttttgaagattaactcgacaatatggccagctaatgaaattaaaaaggattcttcatcatggatttcgcctaagtgatattacagccacctcattcttctaaaagtggatatttttctgtaaatagctggaaatattataaatcactattttggtcaaagtcaaa

SEQ ID NO: 152972 - DNA, 3954 bp, Homo sapiens
  Payload ID: 10090
  Gene Symbol: MERTK
  Gene Name: MER proto-oncogene, tyrosine kinase
  Uniprot ID: Q12866
  ENST ID: ENST00000295408
  CDS Start-End: 258-3257
aacctgctgggcccgccgggactcgcccccctgcccgctcctctcctccagccccggccggcctcggctcggcccccggcccgccccttccagccctcggcacctcccgccggccgcttggctccgccactcggcactcactgcccgggccgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcagtgtacctaatatataccaggacaccacaatttcttggtggaaagatgggaaggaattgcttggggcacatcatgcaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaataaggaaggatatgttgaacttacttgagacttgaaagacagtggtcggcagcggccttgtggcctttgcaaaggaattcccttaatgcctggtccttggggcaattgctctgaccattcttggcattgctttatagagatatggaaaaaccacaccagggtctgtagataaggaataaagaatattgaaggattgaaaaa

SEQ ID NO: 152973 - DNA, 3189 bp, Homo sapiens
  Payload ID: 10090
  Gene Symbol: MERTK
  Gene Name: MER proto-oncogene, tyrosine kinase
  ENST ID: ENST00000409780
  CDS Start-End: 215-2686
cgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaataaggaa

SEQ ID NO: 152974 - DNA, 3600 bp, Homo sapiens
  Payload ID: 10090
  Gene Symbol: MERTK
  Gene Name: MER proto-oncogene, tyrosine kinase
  Uniprot ID: Q12866
  ENST ID: ENST00000421804
  CDS Start-End: 129-3128
ctcggcactcactgcccgggccgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcagtgtacctaatatataccaggacaccacaatttcttggtggaaagatgggaaggaattgcttggggcacatcatgcaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattaattttctgatatggcttcctaataaaatatgaataagga

SEQ ID NO: 152975 - DNA, 2972 bp, Homo sapiens
  Payload ID: 10090
  Gene Symbol: MERTK
  Gene Name: MER proto-oncogene, tyrosine kinase
  ENST ID: ENST00000439966
  CDS Start-End: 73-363
ggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttg

SEQ ID NO: 152976 - DNA, 771 bp, Homo sapiens
  Payload ID: 10090
  Gene Symbol: MERTK
  Gene Name: MER proto-oncogene, tyrosine kinase
  ENST ID: ENST00000449344
  CDS Start-End: 1-771
catattcctctgcagacactattgaagttcatggtggatattgccctgggaatggagtatctgagcaacaggaattttcttcatcgagatttagctgctcgaaactgcatcacccacctggccatcttagcaagaagcccagcatcttgctcttactgcaggttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatggg

SEQ ID NO: 152977 - DNA, 3104 bp, Homo sapiens
  Payload ID: 10090
  Gene Symbol: MERTK
  Gene Name: MER proto-oncogene, tyrosine kinase
  ENST ID: ENST00000616902
  CDS Start-End: 1338-3104
actcactgcccgggccgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcagtgtacctaatatataccaggacaccacaatttcttggtggaaagatgggaaggaattgcttggggcacatcatgcaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggaggcagagattgcatactgctttgccatgtttttacccattcaagccttggcagacagaacttgcagtccttaccttgcagggctccaggacaaacccacatgacattttacaaaataaagaaatgcaaagtttctaacattttaaactacagtagaagtaaatttgttcttccctgttacaagttgggtagattatgccccctcttcaactccggcgcctggcaacgcagatcctgtgctcatcatctttggctgcttttgtggattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctagggttatgcatgattgatgctgtgtttgtaatttcaggtattattatcctgctttatgaaaatcaccgagactcttccaaagagcataggccagcctgtatttttttacatcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagccaggtgggcatgtgcagaggggaggtcgaggttgcagatgaaattgcccatttgtgggagtagggccaccaaaaaagtctcaataatttttataaaaagtagaatgaatgctgataaaaacaaaggcatggattgcacaaagagatgtactcttgctggagaaccgatccctgaccgccccaccttttcagtattgaggctgcagctagaaaaactcttagaaagtttgcctgacgttcggaaccaagcagacgttatttacgtcaatacacagttgctggagagctctgagggcctggccctccacccttgctccactggacttgaacatcgaccctga

SEQ ID NO: 152978 - DNA, 1504 bp, Homo sapiens
  Payload ID: 10091
  Gene Symbol: MPST
  Gene Name: mercaptopyruvate sulfurtransferase
  Uniprot ID: P25325
  ENST ID: ENST00000341116
  CDS Start-End: 306-1199
gctgcaggttggtggcgggaggaggggacagctgcgggcgcggggagggggcgccgcgccgcgggggccatggcggagccaggaagccgggagtccgagacccgggtcgccaatataaatgcttgatgagtgaatgaatgacttccgtctgggacttggttgcaaataaagccgagctgcatcttagggaggggtggagactttgcccctgtttgtgccttgaagccagcagggccttgccctaggatacctccacccaccctcctgcccagcaagtggaggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaatctt

SEQ ID NO: 152979 - DNA, 2116 bp, Homo sapiens
  Payload ID: 10091
  Gene Symbol: MPST
  Gene Name: mercaptopyruvate sulfurtransferase
  Uniprot ID: P25325
  ENST ID: ENST00000397225
  CDS Start-End: 916-1809
ctctggtatgcaggaaagatagagaggagagggagggaggtgcgaagtcactgttgctgctgctagaagggccagagagagcccaggctggacaggcaaaacctggcctcgccagactcctggagcctgcacagagtgtgtgtctgagaagtccggattctggtgccagactgactgcctagtgagaagcctggcaccgccgggtcaggctagtgcactttttcttgtttgttttttgtttttgagacagagttttgctcttgttccccaggctggattgcaatggcacgatctcggctcactgcaacctccgcctcctgggttcaagcagttctcctgcctcagcctcccgagtagctgggattacaggtgccctccactaagcccggctaattttttgtatttttggtagagacggggtttcaccatgttggccagactggtttcaaacttctgacctcaggtgatccacctgcctgggcctcccaaagtgctgggattacaagcgtgagccaccgcaccaggccaggttagtgcacttctgtgagcctgagtgtcctccttgaaacggtgacaataatataccaggcctcttaagatcactcattcaacacatactggagagtctactgtgtcaggcattgttctaggatattgttaggattcagtggtacccagcaaggactcagtaaattccagctactgttcctattaggtcgccaatataaatgcttgatgagtgaatgaatgacttccgtctgggacttggttgcaaataaagccgagctgcatcttagggaggggtggagactttgcccctgtttgtgccttgaagccagcagggccttgccctaggatacctccacccaccctcctgcccagcaagtggaggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaatcttgt

SEQ ID NO: 152980 - DNA, 1453 bp, Homo sapiens
  Payload ID: 10091
  Gene Symbol: MPST
  Gene Name: mercaptopyruvate sulfurtransferase
  Uniprot ID: P25325
  ENST ID: ENST00000404802
  CDS Start-End: 280-1173
ggaaggcgcgggcagcagcggctccgagtggccgcggcggtgggctgtgccggagtctcctccctttggtccgctgcaggtcgccaatataaatgcttgatgagtgaatgaatgacttccgtctgggacttggttgcaaataaagccgagctgcatcttagggaggggtggagactttgcccctgtttgtgccttgaagccagcagggccttgccctaggatacctccacccaccctcctgcccagcaagtggaggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaa

SEQ ID NO: 152981 - DNA, 1345 bp, Homo sapiens
  Payload ID: 10091
  Gene Symbol: MPST
  Gene Name: mercaptopyruvate sulfurtransferase
  Uniprot ID: P25325
  ENST ID: ENST00000401419
  CDS Start-End: 165-1058
gcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaat

SEQ ID NO: 152982 - DNA, 1329 bp, Homo sapiens
  Payload ID: 10091
  Gene Symbol: MPST
  Gene Name: mercaptopyruvate sulfurtransferase
  ENST ID: ENST00000404393
  CDS Start-End: 28-702
caggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacgggtctggctctaccgcccaggctggagtgcagtggcacaatcatggctcactgcagcctcaacctcctgggctcaggtgaccctccccgctcagcctgaccttgcctttaaaggccactgcatgaggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaat

SEQ ID NO: 152983 - DNA, 1331 bp, Homo sapiens
  Payload ID: 10091
  Gene Symbol: MPST
  Gene Name: mercaptopyruvate sulfurtransferase
  Uniprot ID: P25325
  ENST ID: ENST00000429360
  CDS Start-End: 70-1023
gctgcaggttggtggcgggaggaggggacagctgcgggcgcggggagggggcgccgcgccgcgggggccatggcggagccaggaagccgggagtccgagacccgggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaatcttgta

SEQ ID NO: 152984 - DNA, 698 bp, Homo sapiens
  Payload ID: 10091
  Gene Symbol: MPST
  Gene Name: mercaptopyruvate sulfurtransferase
  ENST ID: ENST00000628507
  CDS Start-End: 24-698
cccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacgggtctggctctaccgcccaggctggagtgcagtggcacaatcatggctcactgcagcctcaacctcctgggctcaggtga

SEQ ID NO: 152985 - DNA, 846 bp, Homo sapiens
  Payload ID: 10092
  Gene Symbol: MANF
  Gene Name: mesencephalic astrocyte-derived neurotrophic factor
  ENST ID: ENST00000446668
  CDS Start-End: 1-214
ggccacgcaggggctggcggtggcgctggctctgagcgtgctgccgggcagccgggcgctgcggccgggcgactgcgaagtttgtatttcttatctgggaagattttaccaggacctcaaagacagagatgtcacattctcaccagccactattgaaaacgaacttataaagttctgccgggaagcaagaggcaaagagaatcggttggtttgaaccctggtgacacttaaattcatttggtggctgtcagcttggactgagcatgtgttaagagtccagggtttacactggctgaatctgactaccagtacaggcagggcaccgaaaaatgccgctgtgggccagtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatgacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcc

SEQ ID NO: 152986 - DNA, 1153 bp, Homo sapiens
  Payload ID: 10092
  Gene Symbol: MANF
  Gene Name: mesencephalic astrocyte-derived neurotrophic factor
  ENST ID: ENST00000528157
  CDS Start-End: 288-845
cttccgtcgctgctgtagtcgcttcctgcggccagcccgggttcaatcagcggccgacaactgtctagggctcagacaccaccagccaatgagggagggcagcgtggagccgcccgtctgggctcgcggctcctggaccaatggggaagtggcatgtgggagggcgccggggggccccccgccaatggggagctacggcgcgcggccgggacttggaggcggtgcggcgcggcgggtgcggttcagtcggtcggcggcggcagcggaggaggaggaggaggaggaggatgaggaggatgaggaggatgtgggccacgcaggggctggcggtggcgctggctctgagcgtgctgccgggcagccgggcgctgcggccgggcgactgcgaagtttgtatttcttatctgggaagattttaccaggacctcaaagacagagatgtcacattctcaccagccactattgaaaacgaacttataaagttctgccgggaagcaagaggcaaagagaatcggttgtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatgacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggatttttttattaaagaaaaaaaatttctagctgtccttgcagaattatagtgaataccaaaatggggttttgccccaggaggctccta

SEQ ID NO: 152987 - DNA, 2707 bp, Homo sapiens
  Payload ID: 10093
  Gene Symbol: MEOX1
  Gene Name: mesenchyme homeobox 1
  Uniprot ID: P50221
  ENST ID: ENST00000318579
  CDS Start-End: 421-1185
gatttaaaagtgtgtcccagcagccctggtccagccctctgcaggcatttgctctgggctccaggacgaactcctcgtcagctggtgcgtctgggttgggacagtgaaaatgtttagtgtcattggcgacaaatacacatacaggggatcccagtaggtaggctggtgcattggaggggcaggagcaagcccgacataggtgtgtgcacacacataggagtagctggccacatgtgtgtgtactttaaggagagactttagttttgggtttttttttttttttggttcctggggtaaattttctgttgaacatttttccctcctatttagttttttttcttttgcatttttaaaaatttgaacataaaaagtataaagaatcaaatctttgaaaggaccgaggcgtgcagcggacagcagatggatcccgcggccagcagctgcatgaggagcctccagcccccagcccctgtctggggctgccttcgaaacccccactcggaaggcaatggggcctcagggctaccccactacccgcccaccccgttctccttccaccagaaaccagacttcctggcgacagcgacggcagcgtaccctgacttctcagcctcctgcctggcagccaccccacacagcctgccccaggaggagcacatcttcactgagcagcaccccgctttcccacagtcccccaactggcacttccctgtctcagacgcccggcgcaggcccaactcaggcccggcagggggttccaaggaaatggggaccagcagcctgggcctggtggacaccacaggaggcccaggcgatgactacggggtgcttgggagcactgccaatgagacagagaagaaatcatccaggcggagaaaggagagttcagacaaccaggagaacagagggaagccggagggcagcagcaaagcccgcaaggagaggacggccttcaccaaggagcagctgcgagagctggaggcagagtttgcccatcataactacctgactcggctccgcagatatgagattgcggtaaacctggacctctctgagcgccaggtcaaagtgtggttccagaaccgaaggatgaagtggaagcgtgtgaagggaggtcagcccatctcccccaatgggcaggaccctgaggatggggactccacagcctctccaagttcagagtgagattctgcatggaggaaaaatgactaaggactgagccccctacccaactacccccaccccaatcccaccttcaccctcttccttccccagccagggcagcctctccacatctttccctgactcttggatatgaaactgcccagcattcctgggagtcttaggattttctaggaagttctgtccagcctcttagcagcctcttccctagggcctttgctcccacactctcatggaatcagacagagatcctaccgggccggatgaatctggaaacagcttcagagatactgcttctcagcgtctcttggctgccacccatgcctcctcctaccgctgttctcctaggtcagccaggcctcctcctggtctggacaccacctggcctggtgggagaggagctttggaaccagctggcgactcggaaagtaaatgcttcaaaaggaaggaaatgacagagacacacgcccttgcccaccttcctctgtaggctgcacatctgaggctttggggccccttagttgtcccgaaaccccaagaaaaatcagaatgaggagagtcaaggacagcaactcagctgctgcaagccagaaacacatccctgtctccaaatttgttggctaagtggagacacttctgagaactgactagagaagacagaaaaatagcccgatgtaggtttcggtgtccccatataggcccgtccacacaggcttgactgggtggacaagaatgaacccatgacagcacctgctgcttcaaaatcaaaatcaatttagggatacagcaggggctgttgggctgtgctccagagaaaaggagcagctactccttttaaatccacgatttctggattgaaaacctgtccagatgctgagttgttgggctgaacaactaggagctgaaaacaacgtagaggctggaaagtgtcccctgcattctggaggggaggggagataataaggagggctgctgggtgagggcctggagatgtggaaccctggagtggaaggttctccagtgacagtgtcctgtgactgcaaaaggggacaagaaaatccctcttcctccatgggatggatttaagctcttgctgtgtgttctacaaatgctgttattgtgggaggaaatgctaggtttttgtgtgtggactgcccagacctcagccaggtcttctggagatgacatttgaggactgatggccaaagagcatgggggactgaagccctggctgcctcagcgctctgtctcccaacaccagctggtgttgcagagggaggtcaacgtgagtttggatctcttgtacgcagatgtaatcattcacatgtaaaaataaccccacctccccaccccaaaaagggcaagagctgtggaaaatgattgccaaatgagatggctggttagagcatgattttttctaaagcatacttcatatattttcttaagattacatcaagctaattgtgcgagctcaattcactttgtaagaaaactctcggagaaataaaatcaataaaaagcaaag

SEQ ID NO: 152988 - DNA, 2129 bp, Homo sapiens
  Payload ID: 10093
  Gene Symbol: MEOX1
  Gene Name: mesenchyme homeobox 1
  Uniprot ID: P50221
  ENST ID: ENST00000329168
  CDS Start-End: 30-584
aaaggaccgaggcgtgcagcggacagcagatggatcccgcggccagcagctgcatgaggagcctccagcccccagcccctgtctggggctgccttcgaaacccccactcggaaggcaatggggcctcagggctaccccactacccgcccaccccgttctccttccaccagaaaccagacttcctggcgacagcgacggcagcgtaccctgacttctcagcctcctgcctggcagccaccccacacagcctgccccaggaggagcacatcttcactgagcagcaccccgctttcccacagtcccccaactggcacttccctgtctcagacgcccggcgcaggcccaactcaggcccggcagggggttccaaggaaatggggaccagcagcctgggcctggtggacaccacaggaggcccaggcgatgactacggggtgcttgggagcactgccaatgagacagagaagaaatcatccaggcggagaaaggagagttcaggtcaaagtgtggttccagaaccgaaggatgaagtggaagcgtgtgaagggaggtcagcccatctcccccaatgggcaggaccctgaggatggggactccacagcctctccaagttcagagtgagattctgcatggaggaaaaatgactaaggactgagccccctacccaactacccccaccccaatcccaccttcaccctcttccttccccagccagggcagcctctccacatctttccctgactcttggatatgaaactgcccagcattcctgggagtcttaggattttctaggaagttctgtccagcctcttagcagcctcttccctagggcctttgctcccacactctcatggaatcagacagagatcctaccgggccggatgaatctggaaacagcttcagagatactgcttctcagcgtctcttggctgccacccatgcctcctcctaccgctgttctcctaggtcagccaggcctcctcctggtctggacaccacctggcctggtgggagaggagctttggaaccagctggcgactcggaaagtaaatgcttcaaaaggaaggaaatgacagagacacacgcccttgcccaccttcctctgtaggctgcacatctgaggctttggggccccttagttgtcccgaaaccccaagaaaaatcagaatgaggagagtcaaggacagcaactcagctgctgcaagccagaaacacatccctgtctccaaatttgttggctaagtggagacacttctgagaactgactagagaagacagaaaaatagcccgatgtaggtttcggtgtccccatataggcccgtccacacaggcttgactgggtggacaagaatgaacccatgacagcacctgctgcttcaaaatcaaaatcaatttagggatacagcaggggctgttgggctgtgctccagagaaaaggagcagctactccttttaaatccacgatttctggattgaaaacctgtccagatgctgagttgttgggctgaacaactaggagctgaaaacaacgtagaggctggaaagtgtcccctgcattctggaggggaggggagataataaggagggctgctgggtgagggcctggagatgtggaaccctggagtggaaggttctccagtgacagtgtcctgtgactgcaaaaggggacaagaaaatccctcttcctccatgggatggatttaagctcttgctgtgtgttctacaaatgctgttattgtgggaggaaatgctaggtttttgtgtgtggactgcccagacctcagccaggtcttctggagatgacatttgaggactgatggccaaagagcatgggggactgaagccctggctgcctcagcgctctgtctcccaacaccagctggtgttgcagagggaggtcaacgtgagtttggatctcttgtacgcagatgtaatcattcacatgtaaaaataaccccacctccccaccccaaaaagggcaagagctgtggaaaatgattgccaaatgagatggctggttagagcatgattttttctaaagcatacttcatatattttcttaagattacatcaagctaattgtgcgagctcaattcactttgtaagaaaactctcggagaaataaaatc

SEQ ID NO: 152989 - DNA, 1206 bp, Homo sapiens
  Payload ID: 10093
  Gene Symbol: MEOX1
  Gene Name: mesenchyme homeobox 1
  Uniprot ID: P50221
  ENST ID: ENST00000393661
  CDS Start-End: 257-676
agccctctgcaggcatttgctctgggctccaggacgaactcctcgtcagctgaaaccagacttcctggcgacagcgacggcagcgtaccctgacttctcagcctcctgcctggcagccaccccacacagcctgccccaggaggagcacatcttcactgagcagcaccccgctttcccacagtcccccaactggcacttccctgtctcagacgcccggcgcaggcccaactcaggcccggcagggggttccaaggaaatggggaccagcagcctgggcctggtggacaccacaggaggcccaggcgatgactacggggtgcttgggagcactgccaatgagacagagaagaaatcatccaggcggagaaaggagagttcagacaaccaggagaacagagggaagccggagggcagcagcaaagcccgcaaggagaggacggccttcaccaaggagcagctgcgagagctggaggcagagtttgcccatcataactacctgactcggctccgcagatatgagattgcggtaaacctggacctctctgagcgccaggtcaaagtgtggttccagaaccgaaggatgaagtggaagcgtgtgaagggaggtcagcccatctcccccaatgggcaggaccctgaggatggggactccacagcctctccaagttcagagtgagattctgcatggaggaaaaatgactaaggactgagccccctacccaactacccccaccccaatcccaccttcaccctcttccttccccagccagggcagcctctccacatctttccctgactcttggatatgaaactgcccagcattcctgggagtcttaggattttctaggaagttctgtccagcctcttagcagcctcttccctagggcctttgctcccacactctcatggaatcagacagagatcctaccgggccggatgaatctggaaacagcttcagagatactgcttctcagcgtctcttggctgccacccatgcctcctcctaccgctgttctcctaggtcagccaggcctcctcctggtctggacaccacctggcctggtgggagaggagctttggaaccagctggcgactcggaaagtaaatgcttcaaaaggaaggaaatgacagagacacacgcccttgcccaccttcctctgtaggctgcacatctgaggctttggggccccttagttgtcccgaaac

SEQ ID NO: 152990 - DNA, 1152 bp, Homo sapiens
  Payload ID: 10093
  Gene Symbol: MEOX1
  Gene Name: mesenchyme homeobox 1
  ENST ID: ENST00000549132
  CDS Start-End: 118-621
aaaggaccgaggcgtgcagcggacagcagatggatcccgcggccagcagctgcatgaggagcctccagcccccagcccctgtctggggctgccttcgaaacccccactcggaaggcaatggggcctcagggctaccccactacccgcccaccccgttctccttccaccagaaaccagacttcctggcgacagcgacggcagcgtaccctgacttctcagcctcctgcctggcagccaccccacacagcctgccccaggaggagcacatcttcactgagcagcaccccgctttcccacagtcccccaactggcacttccctgtctcagacgcccggcgcaggcccaactcaggcccggcagggggttccaaggaaatggggaccagcagcctgggcctggtggacaccacaggaggcccaggcgatgactacggggtgcttgggagcactgccaatgagacagagaagaaatcatccaggcggagaaaggagagttcaggtcaaagtgtggttccagaaccgaaggatgaagtggaagcgtgtgaagggaggtcagcccatctcccccaatgggcaggaccctgaggatggggactccacagcctctccaagttcagagtgagattctgcatggaggaaaaatgactaaggactgagccccctacccaactacccccaccccaatcccaccttcaccctcttccttccccagccagggcagcctctccacatctttccctgactcttggatatgaaactgcccagcattcctgggagtcttaggattttctaggaagttctgtccagcctcttagcagcctcttccctagggcctttgctcccacactctcatggaatcagacagagatcctaccgggccggatgaatctggaaacagcttcagagatactgcttctcagcgtctcttggctgccacccatgcctcctcctaccgctgttctcctaggtcagccaggcctcctcctggtctggacaccacctggcctggtgggagaggagctttggaaccagctggcgactcggaaagtaaatgcttcaaaaggaaggaaatgacagagacacacgcccttgcccaccttcctctgtaggctgcacatctgaggctttggggccccttagttgtcccgaaacc

SEQ ID NO: 152991 - DNA, 2500 bp, Homo sapiens
  Payload ID: 10094
  Gene Symbol: MEOX2
  Gene Name: mesenchyme homeobox 2
  Uniprot ID: P50222
  ENST ID: ENST00000262041
  CDS Start-End: 411-1325
ctgggagcgcgtggcgcaggctgagcgggagttttggagggagtttgcatgtggtcaactctgggctcctaagccagcccccagctcacgttacactctatttataacttctcagagccatttccccctgaaagcagttctctgggaccaccttcttttggcttcaacctctcccactcttgacatctgagtagctcagggaagctcttccaggtccgactgttcatatgtaaaggagactggccgctggggctcaggaccgggattatccgagctctgcagaagtgcaccgctattgctttgggaggttaaaaaaaaaatcacacggtttccagtgaaaaagtgacagagggtggtggcctttggaaccgccgtgaagtcttctgcctggaacccgaaacttgcatgctatggaacacccgctctttggctgcctgcgcagccctcacgccacggcgcaaggcttgcacccgttctcccaatcctctctcgccctccatggaagatctgaccatatgtcttaccccgagctctctacttcttcctcatcttgcataatcgcgggataccccaacgaagagggcatgtttgccagccagcatcacagggggcaccaccaccaccaccaccaccaccaccatcaccaccatcagcagcagcagcaccaggctctgcaaaccaactggcacctcccgcagatgtcttccccaccgagtgcggctcggcacagcctctgcctccagcccgactctggagggcccccagagttggggagcagcccgcccgtcctgtgctccaactcttccagcttgggctccagcaccccgactggggccgcgtgcgcgccgggggactacggccgccaggcactgtcacctgcggaggcggagaagcgaagcggcggcaagaggaaaagcgacagctcagactcccaggaaggaaattacaagtcagaagtcaacagcaaacccaggaaagaaaggacagcatttaccaaagagcaaatcagagaacttgaagcagaatttgcccatcataattatctcaccagactgaggcgatacgagatagcagtgaatctggatctcactgaaagacaggtgaaagtctggttccaaaacaggcggatgaagtggaagagggtaaagggtggacagcaaggagctgcggctcgggaaaaggaactggtgaatgtgaaaaagggaacacttctcccatcagagctgtcgggaattggtgcagccaccctccagcaaacaggggactctatagcaaatgaagacagtcacgacagtgaccacagctcagagcatgcgcacttatgatataaacagaggaccagctccattctcaggaaagaaatgttgtgatggcaagccttacccaaatatcgtttacacagagagatgactatggcagtgatgtttaatattattaaatccaggcatttcgaatctgtttttcatgatttatagagggtttacacaaagtgccacttattaaagagcttccacagtgaagatggagaaggtgaacttgctttgaatattccagatgtgtttggtcgtgcgtatggcagtgagcaggtatgtgtttgcttttgcttgcactgaaaattaaattgctatcaagagcaaactatgaacggttttttattcaagatgtctccagagtgaagatgccgaggatgaacttgcattgaacattccagatgtgtgagatcatgtgtattacagtgggcaggtatttgcttttgcttgcactgaaaattaaattgctatcaagaataaaccatgaaacattttatcctgaacagccacagtgcctgaattcactcaagtggataaaaagtgtattttaactctgtatatattacccttaagtcattttcctgtcttcactaatttagcaatgcattcatattagctgatgaaaataggcactcacaatgacaaccagagccagtttcttgtcttttttatacattttgtcatcccagagacaatcagtatgtgcttacctgtgttcaagtagagaaaaatacagtagagtctgataggacatattcttgtaccacagacaaaacaaatcttatgttgcatttactatcaactgctgctaatacgttattataaaacttacctagctcctgaattcttcctatcttatagcttaaaacaattaggatcataggcaaatcagttaccttgcagaaagagctttgtatgacagacattgtcttattttatttctgtaaaatattagctgtatgaatatgatttaattaacaagaaaacatttcttcctgattgacaacagtgttagacaaggtgcaaagcgaaactggttgctcaagttgatagaaaacaaaattctgaatatcttcaaattaaattcggtaaaaacacattattttttcatatgtgatgtattcatgcagaacaactatctttgtattttgtttttaaaatgtgtttaataaatgatcctttgtaaataa

SEQ ID NO: 152992 - DNA, 2374 bp, Homo sapiens
  Payload ID: 10095
  Gene Symbol: MEDAG
  Gene Name: mesenteric estrogen-dependent adipogenesis
  Uniprot ID: Q5VYS4
  ENST ID: ENST00000380482
  CDS Start-End: 326-1237
ctggggtcgtggccgtgggccggcaggggcgaggcgggcgtccagagggcggataaaaggggccgcgctgcgccggggccgctttctccgcgcggtgcctgcagggctcccagcgagtggcagcttgggaggggccgcccgggcggtcagactggcacctgagcggccaccgcgtcccggccaggcgggcagaccgaccccctcctcacctcgcgcgcggctgacgcaggcagggcgcccggcccctcctggggaccatcaggtgccggctgggggctgtaggcaccggacggaagcaggcggtgtgaggaccgacgacgcgggcatggcgggggcggcctgcgagccggtggccaggccgagcctgacctccatctcgtctggggagcttcgcagcctgtggacctgcgactgcgagctggccctgctgccgctggctcagctgctgcgcctgcagcccggtgccttccagctgagcggcgaccagctcgtggtggccaggcccggggagccggcggcggcgcgggggggcttcaacgtcttcggtgacggcctcgtgcgcctcgacgggcagctctaccgcctcagcagctacatcaagaggtatgtggaactgaccaactactgtgattataaagactacagggaaactatattgagcaaaccaatgttgttctttattaatgtacagaccaaaaaagacacctcaaaagaaaggacgtacgcgtttcttgtaaacacgaggcaccccaagataagaagacagatagagcaagggatggacatggtcatctcctcagtgattggagaaagttaccggcttcagtttgattttcaagaggcagtgaagaatttcttccccccaggaaatgaagtggttaatggagaaaatttaagctttgcatatgaattcaaagctgatgcattatttgatttcttctattggtttgggctcagtaattccgttgtaaaagtaaatggaaaagttctgaatttgtcaagtacaagtccagaaaagaaggagacgattaagttatttctggaaaaaatgagtgagcctttaatccgaaggagcagtttctctgaccgaaagttcagtgtaacttccagaggttcaatagatgatgtttttaactgcaatctgtcacccagatcatctctgacagagcctcttttggcagaattaccatttccaagtgttctggaatctgaagagacacccaaccaatttatctgattgaactgaacattgtagcagttgctcccgcactccaggcctgtgctagactataggctggggggagggtaggaggtgggaggcagatacttccacctgcgtgtcaatctccggctcctccatggcttctatggaggactcctctcttctgcttctgtggatgtgatgccctggcaggcccagggcagctgattcccctaaaacttatgattaccaggatggaaaggccttggtcccatggcactgggtggggctgggggatattctctactttgaacacttctccaaagaggcagaagggccacagagttctgccaccctgaacatttttctcagttccctgggagtttttgtggcagcctttgtgggagtggtctgactggctgttgacctagcatgcttcataaatcagggtttggccctctgcttggagcatccaaccccttgaactcaaacctgtcgagcaaggggttaagagttctgttctcttgccaacctggctgggcaaaagcctgtgccatctttcactgggaggcaaatatgtttttcatcctgccatatgacacctatgagaaacgttcacagtgaggagtagccaggttgctaggacagtaaccctgccacacactgcctgaaatcggaactcccttggcctccctcttaactaagtgacccatgtagaaggaagccaggagatatggtaccgaacaatgacaggggaagggtattggacacggcagcgtcctccttattgaaaacacattatgtcagttgggaattttaaataagcttttagcaaacctaacactaaaagcaaaatagaagaaagctataccattaccataatacatttttcatctcatggctacaatggaattcttgaaaaggaaaaaaaaatcctatctacatataaaaacctgcatgaatgaatcactacatatgcttataatgaggaagagttatgggtcctgagtgtaattttttatcctttcttaaaaagtttctgtattatgcattttgataacactactgatgatccttccacttatatttgaaatgttatgtaccacatttgcacaattaaaacttttcttagcattcaacctagaattgattaaatttatgactgaggcttca

SEQ ID NO: 152993 - DNA, 450 bp, Homo sapiens
  Payload ID: 10095
  Gene Symbol: MEDAG
  Gene Name: mesenteric estrogen-dependent adipogenesis
  ENST ID: ENST00000428944
  CDS Start-End: 1-320
cggcggcgcgggggggcttcaacgtcttcggtgacggcctcgtgcgcctcgacgggcagctctaccgcctcagcagctacatcaagaggtatgtggaactgaccaactactgtgattataaagactacagggaaactatattgagcaaaccaatgttgttctttattaatgtacagaccaaaaaagacacctcaaaagaaaggacgtacgcgtttcttgtaaacacgaggcaccccaagataagaagacagatagagcaagggatggacatggtcatctcctcagtgattggagaaagttaccggcttcaggttcaatagatgatgtttttaactgcaatctgtcacccagatcatctctgacagagcctcttttggcagaattaccatttccaagtgttctggaatctgaagagacacccaaccaatttatctgattgaactgaacatt

SEQ ID NO: 152994 - DNA, 4845 bp, Homo sapiens
  Payload ID: 10096
  Gene Symbol: MESDC1
  Gene Name: mesoderm development candidate 1
  Uniprot ID: Q9H1K6
  ENST ID: ENST00000267984
  CDS Start-End: 1329-2417
gggaggttacggccgaggcggcggcggcggcgagcccgggggcgaggcgcggacgggaacaggaaaagcctccggcagcccctgcgggcggcggcgcagccacggccgcgctccgaggtgaagccgcgcgcggagaggaagcgggtgttttcccctctgcctttcggcccccgcccttcctttcagtttctgcccgctcgctcggaagttggcggttgacaaaaatggcaggagccggggcccgggccggttgccgcagcgccgcggggaccttctgagttggcccggtggcagggagactcgtgcaggggcgtccgatgcgcggggcccggggcctcgggagagctcagctgctgcgggccccagacgaggcgacagggatggacttgcgtagacagccagcgccgggccgccgggcgcgcggtctgggagggcgtgccgccgcggcgccgggccgcgctctgtgaaccggcgaggcgggaaggggccgccgtggtgctcggcacgcccgggcgtgtggcgggcgggcgagagcttgagcgcgatccgggcggccgctgtgcgcaatcagtgcaggctcccgcccgactctgactcggcgcggccgcgacagtgccggccacaccctctgccccgctgccgccggcgccgcttcccaagagctggaggcaggagatgcgcccggggcggccgcgcgtcccagagagccagccccggccgccgtcgcggggaagtgccgcctggtggggtcacggcgcctgaagcccacgtgcgccgccgagcccgaggtggcctcgagcgcggcggctgacagcacagcccgcctgagctgcctcccgcgctcctccccgaggaaaggattttgatttcaaagaaaggaaggaaggaaggacaactcccagcttccccgtcccgccctccccgctccgagggccgcgccaggccatgcccaagaaggcggcggcggcggcgaaccagcagaagggactttcctggcagcccggcgacgaggagcgcggacagtgagtttgctctgccccggttcatggttcctgcaagccctctaggaggccgaaagctgcagcccctccccttgccccgaagagccttccgcgttctctcgccctcgggcccaccccgcgccgcccgggctcccgccgccgcagcccagtgccctctgcccgcggcggtggatggcatgatggtgcggggaaggcaccgcggccttggccagctgagtcgcgacggccgccggggcggcggcagtggccgcggcagcggcggtggtagcgggctccccagcggcatgccagtgccccccgggcgcgatggctagcggcagcgccgggaagcccactggcgaggcggcttctccggctcctgcgagcgccatcggcggggccagctcgcagccgcggaagaggctggtatccgtctgcgaccactgcaagggcaagatgcagctggtggctgacctgctgctgctgtcgagcgaggcgcggcccgtgctcttcgagggccccgcctcctctggtgccggcgccgagtccttcgagcagtgccgggacaccatcatcgcgcgcaccaaggggctctccatcctcacccacgacgtgcagagccagctcaacatgggccgcttcggggaggcgggggacagcctggtggagctgggcgacctggtggtgtcgctgaccgagtgctcggcccacgcggcctatctggccgctgtggccacgccgggcgcccagcccgcgcagccgggcctggtggaccgctaccgcgtgacgcgatgccgccacgaggtggagcagggttgcgccgtgctgcgcgccacgccgctggccgacatgacgccgcagctgctgctggaggtgtcgcagggcctgtcgcgcaacctcaagttcctgacggacgcgtgcgccctggccagtgacaagtcacgggaccgcttttcgcgggagcagttcaagctgggcgtcaagtgcatgagcaccagcgcgtcggcgctgctggcctgcgtgcgcgaggtgaaggtggcgcccagtgagctggcgcgcagccgctgtgcgctcttcagcgggcccctggtgcaggcagtgagcgccctggtaggcttcgccaccgagccgcagttcctgggtcgcgcggcagctgtgagcgccgagggcaaggcggtgcagaccgccatcctgggcggcgccatgagcgtggtgtcggcctgcgtgctcctgacccagtgcctcagggatctggcgcagcaccccgacgggggcgccaagatgtcggaccacagggagaggctgaggaactcggcctgcgccgtgtctgaaggctgcaccctgctatctcaggctttaagggagaggtcttcgcccaggactttaccgccagtgaattccaattctgtgaattagcaccccacccccataccccttcttccacccccagactaaaggaagatacttactctctgcccctctccatttataccaaagaaatcataggtgaaaccccctaccctccccaacgttaaatgctcgagaggaatcttccacaaggcagggccatgcacgcaacctgcacacgcacttggagggcccaggtgtctctccaccagcccccatgcagtagggactggaagatatgtcatctgctggttgtgttatcactcccaccccctaccccagcccgtcttccggaatttctcaactaaatttcattattgggcaggaaggaggtcatgggttcatttcatttttgttttttgtgtttttaattaaaagaaaggttacctcagttttcactccttagacatggatgtagctacctttttttgtatgtcttttttttttttaagcaatcgtgttgaattaggagtatacttggtgtggaaagagtatgaatttgccatgtgatttgcaaatggggggaagctactgtgagcgtgtgtttttttaatttacactatagagtgatttttttttcccccaacgtcaagtttttaccttgcatgtactggagtatttatttcatctattaaaatgttatgtttctcagatggctttttgcaattattgttgatttttcaataattgtaattttgcatgctgcatgtcatgtatgggaagggtctgtgggaaggctatttcaatagtagtgaggcgggcccccaattcccagccctttctactatttcctcaagaaaaagtactgctcaagaagtactcccttgagcagcctggaactgaagagaggactatgtgtaacgttctattttaaaaggcaggtgacacaaatgggattgggttatgtagagtgcttgggacggttttgtctcatttttcctggaaagtgatttagctccctttgtctccacttacctttccatcatcatgaacagtggctcaggctgcttgaattctgatttgtattctgcctatcattttcagattaaatcctaatcctgtgtggtatgccagccttcccaactcagagtctctggatggaactctaaaagtactgtacatcaagtgagaatagttagcatcttttatgtacacaggtctattcagacaagatcctcatgatttcagaaaaaatatagagagggtcctagactgcttaatagaggaaagaagtatcctggaaagcttgttaagaacgttctagagccacaacatgattgtaggccaagggcttgtttttgtgaccttgatctaagataatgccatggttgattgtatgttggaagaatctttgattggaatttggagtaatattaaggtagtttgtcttttctgcagacatttttaggagtctttttgtgtgagtggtggtggagtgtatagttttgttgaacctagttaaattctgaatatcttcccactaaaagcacaacaaatctatttacagtgcctgaagcctgggagagccacatgagtaaaaactcgtacgtggtttagatttgttccatttacatttttcttgggatttgttgtgcttaaacctttgcagttcccacagatctgaaaagaaagcatttttcactgtaatacattaagagagagagaaaaaagtcatattgactattttacttgtttgaatcgctgtttttattacaatgacatgaaatacaacgtgtaaaagtctttaacctgtgttgggtaagggtaggactgtttcaccaccctgaatttgaaatttgaaaaagtcttaaagtggtagggtacttaaatttttaaaaaaatgaccatgggagcagtttttctctgttaaatcctggtaaacttcgggtttttgaagactttaaaagatgaaaatgaccttgagcatctttattcctttcctctgccccttaatgttgggatggggttcaggatgaaagggaggtgggattctaattcatgtgccagtgacaatcctgcatgcatatagaaatttttatttattgaatgtacacaagtaatgatggagtttgattatatggttcattttcatttatcctatgcagatcacaaagagtaaactgaaaggaacaaacgctaagtaaaataagggccagaaatctgtaaatttggtattagattaagaaaaaaagaattgccagttttttcctggactctttccttgcagaagcgattttcaggacaactcaagccaattaaaaaaaagaaaatcactttccctatctgtttggatgaagttaactagctagtcactaagtgaattttgaaacctcttacctaaatgatagctgctcttggtgtttctttatgctctacgtttggtcatgtaacatgcataatctctgttctctgaagttgattaaagttctaaacttaa

SEQ ID NO: 152995 - DNA, 4264 bp, Homo sapiens
  Payload ID: 10097
  Gene Symbol: MESDC2
  Gene Name: mesoderm development candidate 2
  Uniprot ID: Q14696
  ENST ID: ENST00000261758
  CDS Start-End: 88-792
aaggcggacaggaaggcgtgtgcaaggcggggtccggcccgcgcaggtcgggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaattgtgattttaataaattaaaagtagcacattacatggttagaaaatgtcagtgttaaagaatggtacaaagtgaaaagtgtatccctctcttgccgccggtggtagcttgtcccagtggaagctgctgttaacaatttgtgcccccacatccccctccctgcccatccaccaaaaaaaagtacatttacttatgtaaatgtacttatggtgatgtatgtttgttttggcctcacagcatctgtttccccttaatttggtagctgctcacatttccctcgaaagaaccacaccctctgcattctcagttctctgctttggatgggacatttgccctgcagtccccccaccctccaggccatgccctctccagggtgaggcctgtgtgatctaccgtactagggtactaggccctgaaagaggcttttcttgttcctcctgcatcttgaacctggagcgggagctgttgtaggccccgcccttggagaagagaactgtctgacagtggggagagagcgccacaccctggtggcataaacgagtccctgaatcatgccgtggctgaaccaagccctgtctgtgggctttttctgttgtactcagggcagtttgatggggttactgtcctgcatagccataatggcccagtataaagcagctgttttgatgagataattgctttaattaagcaaaaggtagcaaagctttcactccgccctgtaccttctgtttccacttaggagccttcccatgtcagaatgtgcagatctgtctcattgtttcctgtgcagtgtgcccccacttcacccagtagtttctgtgtgtctgttatgtactaggtactacaaggtgccaggacggtgtagatacagcctctgctatcgtaaaactcaatgattcggtgggggaagacaaatgtcagtaatgtacaaagtaaaatggcagctgttagaagtatgaaaggggcagggtagggggaggtagaatcttccctgaccaggttaagaaaaccagaggccttctctgagggcaagaggaggagaggagaaatagagtaaggcaggcagaggaaacagtctgagctaagaccctgtggctagaagtggcagagggagaggcagcaggaaggccagcggggaggctggggcccagtgcaggcccaggttggaggagcgtagcacatggagtttggtaggagtttgggacgccctggtggatcttaattgtgatggggtgggtgtgaaaggcagtccaggttgcactggttgcacaggagaagtgatcagaagaggaccccagcaggtgtgagccgtgagctgggaggtgcttcagtagtgcaggccatagctgaaggtgtcctacatcagcagggtgatggtgaggtttgaaccactgtttcactgcatagtccctgctgatggacacttgagtgttcagattttttgctggtatattcagtgctgcagtggacattttcatacaaaatatttcggtacacttttgtttatatctgaaaggtaaattcctagcagtagaattattagagcaaacggaatttaacattttggtgtgtattgccaaattgccctcccaagtggtttagtcagcttacccttgccaacaatagatctatccttgccagccttgggcatcacatttaccagtttaatagattgtaaaaccatatcttaattggctaccctgaagccaccatactggagaggctgcgtacagtgtttcacgtagagagagggatacccaggaggcccacctgctccaaccccagctgcatgagtcttcccagcccaggcacagacatgtggataagatttaaacatttccagccccagccttcaagcaatcctagttgacactgaggggagccaacataagctgagctgagaaacagtctgcccagtctgcagattcatgagcaaaagaaatgttgggctgggtacagtggctcacgcctgtaatcccagtactttgggaggccgaggtgggtggatcagttgaggtcaggagtttgagaccagcctggccaacatggtgaagccctgtctctactaaaaattagccgagtgtggtggtgcgggcctgtaatcccagctactcaggtggctgaggcaggagaatggcttgaacccgggaggcggaggttgcagtgagccaagatcaggccactgcactccagcctggatgacgggatgagactctgtctcaaaaaaacgaaacaaaaattttttaagagaaatgtcatttgtttttgtttttgagacagggtctcactctgttgccctcactagagtgcagtaggatcacggctcactgaagtctctacctaccggctcaattgatcttcccaccacagcctcccaaatagctgggagaaatgtcctgtttttaatgaatttgtcttcctttttgtcttgtttgttttaatatctagtgatctaataaatttggatgatatcttttgactatcaattatg

SEQ ID NO: 152996 - DNA, 1392 bp, Homo sapiens
  Payload ID: 10097
  Gene Symbol: MESDC2
  Gene Name: mesoderm development candidate 2
  Uniprot ID: Q14696
  ENST ID: ENST00000422879
  CDS Start-End: 29-445
gtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagacccctgagccccttccagtgctgcctgaggtgccctctacctgtgcctgcctctcgtctgccagtttgatttggacctgtttttcccacctcagcccccatgctcttgtcaaacgtgtttggcctccagccaaacagggcctgggaggaaaagagagtcctgcttctgcctggcttccccatcggggaggggagttgaagtgacagcctcctgacagcttagaaatgtggaggacgcagcaagttctggacatggccagccatatgaatgatatcttctctttctttgaaccatctccacctgctcttatggacaccccgccttggggcaaggcaagggatgggcacaacttggaagattttggctttgtgatcctcagtgtccagtgtcacccagatgggccggaagctgcctttgaagccaacgaatgccatttgctctgaaaagcaatgatgagtctcctgagcaaaagccctatgagaggacggctgccccaccccgttccatggctccccatcgccagccccccacgcccaccaggtaccgcctagccacactgcactgtggccccttgggaagagctctgtgctcagctactgatggtgcctgacatgtgtttgtatggggcaggcagggtctcacctgagcctcactgccacctaggcagggtgatggctttgttgtagacaggggagccatgcacagcaggaaatggggcaaactgtaagggaggagacctcctaggaacctgcctacctttgagctgcccctaggacaaccagcaagtccctgcccctctctgaagcccagtgttcccatccatcaaatgatggcattgatctacaagatctccttccccactctatcactctgtggctctagaaagagttctgagaggtgaagaaatttgaccaagagtgtggagtaaatggtgcaccccagattagaactctaaacccctgaaacccacacagcactctccatcttgcagttcacagcttgagcatccgaggggcatgggaatccacgtctatactcagcccatcttggcaggcaacatgcatttatcaccaccgggaaagtgccattcaacttaggtcaccttacatacatcagcttttggcaaccgggatcttaatttaaaagacag

SEQ ID NO: 152997 - DNA, 539 bp, Homo sapiens
  Payload ID: 10097
  Gene Symbol: MESDC2
  Gene Name: mesoderm development candidate 2
  ENST ID: ENST00000559537
  CDS Start-End: 5-247
gaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggaggccaacacctgtcctacttccactcactgaccttccctgaccaatccaggcgatgatcactccctgccctcagaagcctgccacaccactcattgggcagacccctgagccccttccagtgctgcctgaggtgccctctacctgtgcctgcctctcgtctgccagtttgatttggacctgtttttcccacctcagcccccatgctcttgtcaaacgtgtttggcctccagccaaacagggcctgggaggaaaagagagtcctgcttctgcctggcttccccatcggggaggggagttgaagtgacagcctcctgacagctta

SEQ ID NO: 152998 - DNA, 2938 bp, Homo sapiens
  Payload ID: 10097
  Gene Symbol: MESDC2
  Gene Name: mesoderm development candidate 2
  Uniprot ID: Q14696
  ENST ID: ENST00000561312
  CDS Start-End: 38-742
ggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttgacccctgagccccttccagtgctgcctgaggtgccctctacctgtgcctgcctctcgtctgccagtttgatttggacctgtttttcccacctcagcccccatgctcttgtcaaacgtgtttggcctccagccaaacagggcctgggaggaaaagagagtcctgcttctgcctggcttccccatcggggaggggagttgaagtgacagcctcctgacagcttagaaatgtggaggacgcagcaagttctggacatggccagccatatgaatgatatcttctctttctttgaaccatctccacctgctcttatggacaccccgccttggggcaaggcaagggatgggcacaacttggaagattttggctttgtgatcctcagtgtccagtgtcacccagatgggccggaagctgcctttgaagccaacgaatgccatttgctctgaaaagcaatgatgagtctcctgagcaaaagccctatgagaggacggctgccccaccccgttccatggctccccatcgccagccccccacgcccaccaggtaccgcctagccacactgcactgtggccccttgggaagagctctgtgctcagctactgatggtgcctgacatgtgtttgtatggggcaggcagggtctcacctgagcctcactgccacctaggcagggtgatggctttgttgtagacaggggagccatgcacagcaggaaatggggcaaactgtaagggaggagacctcctaggaacctgcctacctttgagctgcccctaggacaaccagcaagtccctgcccctctctgaagcccagtgttcccatccatcaaatgatggcattgatctacaagatctccttccccactctatcactctgtggctctagaaagagttctgagaggtgaagaaatttgaccaagagtgtggagtaaatggtgcaccccagattagaactctaaacccctgaaacccacacagcactctccatcttgcagttcacagcttgagcatccgaggggcatgggaatccacgtctatactcagcccatcttggcaggcaacatgcatttatcaccaccgggaaagtgccattcaacttaggtcaccttacatacatcagcttttggcaaccgggatcttaatttaaaagacagaggctccaaaatgatttcaggactgggctggaaaggatacttctcttttccttatgtcctcctttggctggtttgaagggtttgcattgcttctgatttttctcattgccccatatgatgggtttctgattttgatgttttccatagtgaggatggtgtataactaagaagcccagctttgagttaggaagattaggatccaagtcctaaccttaagcaagtggcttggctgttaaattcttggtgtcctcatcttaaatggaaataatagtacctgctgcacaggttattaatgagtaagtgagataattataacatgttgtgcaaagtgcaaggctgaacattgaatagcaaccacaatgatcattatcattattgcccgtggagcttctctgccgcccatacagcctctctgaggactctccctgcacctagtttttgtgatgataatgggtgtcatgctgacatgtccctcctggatggcttcttccagcacagccagcaagcctgtgctaggcttcaccaccgaagctgcctggccttggacaagccatgtaggttctctgggctttagttttctggaacaaataagagttttgcaagctgcaaaggactgtacaaacgctaggcatcagctagaatgttgaagaagatgcaggacccctggccagtctgaatagcaggaattgggtaggagggtgagactaagccacttttcttatgatacttttgttgaataaagggccactttccaagc

SEQ ID NO: 152999 - DNA, 3978 bp, Homo sapiens
  Payload ID: 10097
  Gene Symbol: MESDC2
  Gene Name: mesoderm development candidate 2
  Uniprot ID: Q14696
  ENST ID: ENST00000619987
  CDS Start-End: 38-742
ggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttgacccctgagccccttccagtgctgcctgaggtgccctctacctgtgcctgcctctcgtctgccagtttgatttggacctgtttttcccacctcagcccccatgctcttgtcaaacgtgtttggcctccagccaaacagggcctgggaggaaaagagagtcctgcttctgcctggcttccccatcggggaggggagttgaagtgacagcctcctgacagcttagaaatgtggaggacgcagcaagttctggacatggccagccatatgaatgatatcttctctttctttgaaccatctccacctgctcttatggacaccccgccttggggcaaggcaagggatgggcacaacttggaagattttggctttgtgatcctcagtgtccagtgtcacccagatgggccggaagctgcctttgaagccaacgaatgccatttgctctgaaaagcaatgatgagtctcctgagcaaaagccctatgagaggacggctgccccaccccgttccatggctccccatcgccagccccccacgcccaccaggtaccgcctagccacactgcactgtggccccttgggaagagctctgtgctcagctactgatggtgcctgacatgtgtttgtatggggcaggcagggtctcacctgagcctcactgccacctaggcagggtgatggctttgttgtagacaggggagccatgcacagcaggaaatggggcaaactgtaagggaggagacctcctaggaacctgcctacctttgagctgcccctaggacaaccagcaagtccctgcccctctctgaagcccagtgttcccatccatcaaatgatggcattgatctacaagatctccttccccactctatcactctgtggctctagaaagagttctgagaggtgaagaaatttgaccaagagtgtggagtaaatggtgcaccccagattagaactctaaacccctgaaacccacacagcactctccatcttgcagttcacagcttgagcatccgaggggcatgggaatccacgtctatactcagcccatcttggcaggcaacatgcatttatcaccaccgggaaagtgccattcaacttaggtcaccttacatacatcagcttttggcaaccgggatcttaatttaaaagacagaggctccaaaatgatttcaggactgggctggaaaggatacttctcttttccttatgtcctcctttggctggtttgaagggtttgcattgcttctgatttttctcattgccccatatgatgggtttctgattttgatgttttccatagtgaggatggtgtataactaagaagcccagctttgagttaggaagattaggatccaagtcctaaccttaagcaagtggcttggctgttaaattcttggtgtcctcatcttaaatggaaataatagtacctgctgcacaggttattaatgagtaagtgagataattataacatgttgtgcaaagtgcaaggctgaacattgaatagcaaccacaatgatcattatcattattgcccgtggagcttctctgccgcccatacagcctctctgaggactctccctgcacctagtttttgtgatgataatgggtgtcatgctgacatgtccctcctggatggcttcttccagcacagccagcaagcctgtgctaggcttcaccaccgaagctgcctggccttggacaagccatgtaggttctctgggctttagttttctggaacaaataagagttttgcaagctgcaaaggactgtacaaacgctaggcatcagctagaatgttgaagaagatgcaggacccctggccagtctgaatagcaggaattgggtaggagggtgagactaagccacttttcttatgatacttttgttgaataaagggccactttccaagcaaatgagtcaacaaatatagcaattttctttcagtggctggtggcaagttataataaatttgctgcagtgcaggggtggtaaacaggtggcatcttgcccatccattccagtagaccactagttgtgtgggggattcttaggttgtacccacgtttagtacaaagcatgttctcaactcagcaaaagatgacagcaccctccatgccaggcatttgccttctctggttttggggtcagtttaaaccccagttcaaacccttacctttcaacttgagacccctgtctgccccaagcttttccagcactctggtccatgggcctctggagacgtatcttccctttgatgccataagcactatggaactgtgtgagaagaaaccaattagaccagagggagagagcaaactggagaaagtgggcatggggagggatgttggtttgtgcatggtgggactggagttagcagtgcccagaggcctgtccagggattcgggaaagggcagcctctcctgtgttctgagctgacgggctctttccatgtggtgacgaacatcctgagctccctcccacacatctggccacagttggtgcccacagccttctccaagcctggacttggctcaccgcgtttacatgtctctctccaaacagaggagaggatgtaagcagagcgtaccatgccagggctcggcacacagtaggacttcgatatgtatctcttcccttgaatgttctcaaccctggttaggtaagaccagatagaaatgtggtgatggaggaaggaaggagaaagggaagagaaagagaggaggtgcgggaaggcggaggggagcatctgtcaaatcataaaaccatccaggagctcctgaaggttctagatcctgaaggttctagagaccagctccatttggcatcccctgggatttcattagaaccacagaattcctccattgcagacttcctgaatcagaatctgcatttttacaagatctgcaggtgatcatgtatacattaaagctcgagaagccccatgctagaa

SEQ ID NO: 153000 - DNA, 6884 bp, Homo sapiens
  Payload ID: 10098
  Gene Symbol: MIER2
  Gene Name: mesoderm induction early response 1, family member 2
  Uniprot ID: Q8N344
  ENST ID: ENST00000264819
  CDS Start-End: 1-1638
atggcggaggcctcctcgctggggaggcagagtcctcgcgtggtctcctgcctcgagcacagcctgtgcccaggggagccgggcttgcagacaacagcagtggtgtccatgggctctggagaccatcagttcaacctcgcagagatcctgtcacagaactacagtgttaggggggagtgcgaggaggcctcgaggtgcccagacaagcccaaggaggagctggagaaggacttcatctcccagagcaacgacatgccctttgatgagctgcttgcgctctatggctacgaggcgtcagaccccatttcagaccgggagagtgagggtggtgacgtggccccgaacctcccagacatgaccctggacaaagaacaaatagcgaaggatttgctttcaggggaagaagaggaagagacgcaatcatctgctgacgacctcaccccgtccgtgacctcccacgaggcctccgacctcttccctaaccggagtggatctcgtttcctggctgatgaagacagagagcctggctcttctgcctcctccgacaccgaggaggactctcttcctgccaacaaatgtaagaaggagatcatggtgggacctcagttccaagctgacctcagcaacctgcacttgaaccggcactgtgagaagatctacgagaacgaagaccagctgctctgggaccccagcgtcctccctgagagggaggtggaggagttcctgtacagggcggtgaagcggcgttggcacgagatggccgggcctcagctcccagagggagaagccgtgaaagacagtgagcaggcgctgtacgagttggtgaaatgcaacttcaatgtggaggaggccctgcgaaggctgcggttcaacgtgaaggtgatccgagatgggctctgtgcttggagtgaagaggagtgcaggaactttgagcacggcttccgtgtgcatggaaagaactttcacctgatccaggccaacaaggtgcgcacacggtcagtgggcgagtgtgtcgagtactactacctgtggaagaagtcggagcgctacgactacttcgcccagcagacgcggctgggccggaggaagtacgtcccgtccggaaccacggacgcagaccaggacctggatggcagcgaccccgatggccccggccgtccgcgcccggagcaagacaccctgactgggatgcgcacagatccactgagcgtggatggcacggccggtggtctcgatgagcccggagtggcctctgatggactcccgtcctcggagccagggccgtgttccttccagcagctggatgagtcccccgctgtacccctgtcccatcggcccccagccctggccgacccagcctcataccagccagctgtcactgctccggagccagacgccagcccaaggctggccgtggacttcgccctgcccaaggagctgcccctcatctccagccatgtggacctcagcggggatccggaggagactgtggccccagcacaggtggctttgtcggtcaccgagtttggactcatcggcattggggacgtgaaccccttcctggccgcccaccccacgtgcccggcccccgggctacactcggagcccctgtcacactgtaacgtgatgacctgctgactcctggccgcgggcggcgtatgcggcccagactggacttagcgctgccgctgggcccgcctctgtcagtcttcctgaccccttccccaccccccgggccttggggtagcacctccttctgcttcagaacacgtcaggactggggtgaggtggctgggccgtgagcccttgcccctgtccacacagaatggacccacggccccacccagcgccgtcagcgcccggcactgccacccgggtccgggccgctgcctgcacgtgggatccgtcgggcagccggggacagaagagaccccgccgttgggacgcagggcagagccggccacctagtcccttccagccagcagaggcgagggaaggcgtcactgccccggcggggagacgggcaggacgccctgccccgcaccagcagcctccgccggggcgccctcagctccctgcttggctctgtctctccacacccggcagggccgcgggctgccccagccctgggggtcgtgggcagctgctactcagtgccaaccccgtggggcacagagccatatacctcgctgtccggcccccaccccagcctcgccttcccaccccatcgtctccacttcaggaaaagccgcactttacacccccacctgcctcttccccctccatccctgctccccgatcctgagcggttggggtggggtccctcagcaaccccaggcgtgggtttgaggagacaggtgatttacatcccctttgctgtcctcccccggtaccaaggcagggagcctccggaggagccggccctgctggccacgcaggggccagactccagcctgtttccccagccctgcaggtcttccttctgtgggaagcttcctagcaagatggcttggagtcctggtccccctcctccctggccctctcgttcgtttctgtttctgtttacacgttggagtggggtcctccgtgggcggcggcgcgccctgccccgggtgtcgtccggcctcttgtgctcgagcccctttccgagttggactcgaccatccctcaccccaccaaggaccacactgtgaagtgataactgccttgaacccccctttgctgttttatttattaaacttgatttgaagcccggggtgccttgtggtggatcgggtgggggctggggcggcaggtgtcctcgtcatctcacttgggggcctgcatgtctcttggagggtccaggataagtcgtgagcaacacgggcgagggggtgcaccgggggcatgacgtggtgggctacgtattgttcacgtcagtaagggaattgtggccacgatgacgggatgtgaggagggcccacgtctgggtagaggtggtcggggcagcctcctagaagtgatatttaagctgaaacatgaaggagaatgggcctcctttgctgaaagtttgccgagaggcctggcaggcgtgacagcagatgcagaggacagaggcctgggtctccaggagaagctgagggcacagagggcagaggttgggcggggtggggacagtaggtcatgaggccaagttttgttcttggtgtggaagccactttaggtctgcattgtttttttgttttgttttgctttttttttttagacagggtctcacactgtcgccaggctggagtgcagtggtgcgatctcggctcactgcaacctccgcctcctgagttcacgcgattctcctgcctcagcctcccgagtagctgggattacaggcgcccgccacctgggattacgggcgcccgccaccatgcccagctactttttatattttttgtagagatggggtttctccttattgcccaggatggtctctatctcttgaccttgtgttctcccgcctcggcctcccaaagtgctgggattacaggcgtgagacatcgcgcccggctgaggtctgcattgttaatagcgccctgcagggacggtgcaggctggttgggttgcatattgtccacatcagtgagggaaatgtgggcatgcatggtgatgggatatggggagggccggcccccagctgggaggtgactgtggcttggcctcagggactattggtgaaggaccaggaccacttgcatgatgggtgtgggagagtcaggggtcttgctggtgagcctgtgccaggagctgtgagaaccagggccagccactcggcaacctgggtgtttggggatgggcatagaggagttttcattggagcgccgcagcctgctgacgttttcttcagatgtgcaaggtcttctgtcttccagcttgccctgcctccagcaggaaatcttcagtcctctcttggtttttttcctccaactgctttgaagatttttcagtaccactggttttgagcagtctgatgaggatgtgctttggtgtattgaggtgtctgatgagggtgtgctttggtgtattgaggagtctgatgagaatgtgctttggtgtattgaggtgtctgatgaggatgtgctttggtgtattgagtctgatgaggatgtgctttggtgtattgagtctgatgaggatgtgctttggtgtattgaggtgtctgatgagaatgtgctttggtgtattgagtctgatgaggatgtgctttggtgtattgaggtgactgatgagaatgtgctttggtgtattgaggtgtctgatgagggtgtgctttggtgtattgaggtgtctgatgaggatgtgctttggtgtattgaggagtctgatgaggatgtgctttggtgtattgagtccgatgaggatgtgctttggtgtattgaggtgtctgatgagaatgtgctttggtgtattgagtctgatgagaatgtgctttggtgtattgagtctgatgaggatgtgctttggtgtattgaggtgtctgatgagaatgtgctttggtgtattgagtctgatgaggatgtgctttggtgtattgaggagtctgatgaggatgtgctttggtgtattgagtctgatgaggatgtgctttggtgtattgaggtgtctgatgagaatgtgctttggtgtattgagtctgatgagaatgtgctttggtgtattgagtctgatgaggatgtgctttggtgtattgaggtgtctgatgagaatgtgctttggtgtattgaggagtctgatgaggatgtgctttggtgtattgatgaggatgtgctttggtgtattgaggtgtctgatgaggatgtgctttggtgtattgagtctgatgagaatgtgctttggtgtattgagtctgatgagaatgtgctttggtgtattgagtctgatgaggatgtgctttggtgtattgaggtgtctgatgagaatgtgctttggtgtattgaggtgtctgatgagggtgtgctttggtgtattgaggagtctgatgaggatgtgctttggtgtattgagtctgatgaggatgtgctttggtgtattgaggtgtctgatgaggatgtgctttggtgtattgagtctgatgaggatgtgctttggtgtattgagtctgaagaggatgtgctgtggtgtattgaggtgtctgatgaggatgtactttggtgtattgaggtgtctgatgaggatgtgctttggtgtattgaggagtctgatgaggatgtgctttggtgtattgagtctgatgaggatgtgctttggtgtattgaggtgtctgatgagaatgtgctttggtgtattgaggagtctgatgaggatgtgctttggtgtattgaggagtctgatgaggatgtgctttggtgtattgaggagtctgatgaggatgtgctttggtgtattgagtctgatgaggatgtgctttggtgtattgaggagtctgatgaggatgtgctttggtgtattgagtctgatgaggatgtgctttggtgtattgaggtgtctgatgagaatgtgctttggtgtattgaggtgtctgatgagggtgtgctttggtgtattgagtctgatgaggatgtgctgtggtgtattgaggtgtctgatgaggatgtgctttggtgtactgaggtgtctgatgaggatgtactttggtgtattgaggtgtctgatgaggatgtgctttggtgtattgaggagtctgatgaggatgtgctttggtgtattgaggagtctgatgaggatgtgctttggtgtattgagtctgatgaggatgtgctttggtgtattgagtctgatgaggatgtgctttggtgtattgacgaggatgtgctttggtgtattgaggtgtctgatgaggatgtgctttggtgtacacgtacagtatgtagcctttgagattggcttctttcatattcactgaaggcttcgccatgtcttttcgtggcttgatggctcatttctttttcgcgctggatgatactccatcctgggcgtgtgctgcagcttgtttatctacgtacctattgaaggacatcttagcttccaagcttcggcagttacgcgtaaagacatcttagcagcttccaagctttggcagttacacataaagacatcttagcagcttccaagcttcagcagttactcataaagctgctgtaaacgcccatgtgcaggtttttgttttgacacaacttttcagcccatttggatgaataaagaaacctgattgccggaccgtgtgatgagaccgtgtttaatgagaagctgccatttcactcccaccagcaatgagtaagcgctcctgaggcccatgtcctccccagtgtttggtggtgtcagtattttgtgtttggccattcgaataggtgtgtagtgggatcttgttttccatagcctttgaagatgtgtacattttcgtacctttctggcgctcttaagttcttcattcagactccgtgttgccaagagggataattttctttgagtctgaagtgccgtatttaatatatattgccttgtagttcctctgcagtgacattctgcctaggcttagctcttacgtggatcaaaaggccctaattcctcctcctcttttgaagtgcatttttacaggatatacggttctaagtggactgtgtttttctctgcgcatgttaaggtggttctattcatgctgttttctactgttctgatgaggaattttctcattctgttttccttactgtgaaatctcttacttctgactatatacatgattttcttttatttttggactttggccgtttgtgatgcacctgggtctagctttctaaactgagctacttcgacctgagggtgggtgcattttaacagattttgaagtcttgactgtt

SEQ ID NO: 153001 - DNA, 1748 bp, Homo sapiens
  Payload ID: 10098
  Gene Symbol: MIER2
  Gene Name: mesoderm induction early response 1, family member 2
  ENST ID: ENST00000619835
  CDS Start-End: 1-631
gcgcacacggtcagtgggcgagtgtgtcgagtactactacctgtggaagaagtcggagcgctacgactacttcgcccagcagacgcggctgggccggaggaaggacgcagaccaggacctggatggcagcgaccccgatggccccggccgtccgcgcccggagcaagacaccctgactgggatgcgcacagatccactgagcgtggatggcacggccggtggtctcgatgagcccggagtggcctctgatggactcccgtcctcggagccagggccgtgttccttccagcagctggatgagtcccccgctgtacccctgtcccatcggcccccagccctggccgacccagcctcataccagccagctgtcactgctccggagccagacgccagcccaaggctggccgtggacttcgccctgcccaaggagctgcccctcatctccagccatgtggacctcagcggggatccggaggagactgtggccccagcacaggtggctttgtcggtcaccgagtttggactcatcggcattggggacgtgaaccccttcctggccgcccaccccacgtgcccggcccccgggctacactcggagcccctgtcacactgtaacgtgatgacctgctgactcctggccgcgggcggcgtatgcggcccagactggacttagcgctgccgctgggcccgcctctgtcagtcttcctgaccccttccccaccccccgggccttggggtagcacctccttctgcttcagaacacgtcaggactggggtgaggtggctgggccgtgagcccttgcccctgtccacacagaatggacccacggccccacccagcgccgtcagcgcccggcactgccacccgggtccgggccgctgcctgcacgtgggatccgtcgggcagccggggacagaagagaccccgccgttgggacgcagggcagagccggccacctagtcccttccagccagcagaggcgagggaaggcgtcactgccccggcggggagacgggcaggacgccctgccccgcaccagcagcctccgccggggcgccctcagctccctgcttggctctgtctctccacacccggcagggccgcgggctgccccagccctgggggtcgtgggcagctgctactcagtgccaaccccgtggggcacagagccatatacctcgctgtccggcccccaccccagcctcgccttcccaccccatcgtctccacttcaggaaaagccgcactttacacccccacctgcctcttccccctccatccctgctccccgatcctgagcggttggggtggggtccctcagcaaccccaggcgtgggtttgaggagacaggtgatttacatcccctttgctgtcctcccccggtaccaaggcagggagcctccggaggagccggccctgctggccacgcaggggccagactccagcctgtttccccagccctgcaggtcttccttctgtgggaagcttcctagcaagatggcttggagtcctggtccccctcctccctggccctctcgttcgtttctgtttctgtttacacgttggagtggggtcctccgtgggcggcggcgcgccctgccccgggtgtcgtccggcctcttgtgctcgagcccctttccgagttggactcgaccatccctcaccccaccaaggaccacactgtgaagtgataactgccttgaacccccctttgctgttttatttattaaacttgatttgaagcccgg

SEQ ID NO: 153002 - DNA, 601 bp, Homo sapiens
  Payload ID: 10099
  Gene Symbol: MIER3
  Gene Name: mesoderm induction early response 1, family member 3
  ENST ID: ENST00000336942
  CDS Start-End: 166-601
gccgggcggaccgcggcggtggcggcggcggctgcgattggctcaggcgccccatccggggactgggctcggcgctgctcgttcgccctaaaggcttcttttggaagttcgagcccagttgggtctttgtcttctgaggatcatgattttgaccccactgctgagatgttggtccatgactatgatgatgaaagaactcttgaagaagaggaaatgatggatgagggtaaaaacttcagttcagaaattgaagacttagaaaaggaaggaaccatgcctctagaagatttactggcattctatggctatgaacctacaattccagcagttgcaaattccagtgcaaatagttccccaagtgaactggcagatgaactaccagacatgacactagacaaagaggaaatagcaaaagacctgttgtcaggtgatgacgaggaaactcagtcttctgcggatgatctgacgccatctgtgacttcccatgaaacttctgatttcttccctaggcctttacgatcaaatactgcatgtgatggtgataaggaatcagaggttgaagatgttgaaacagacagtggtaattcacctgaagatttga

SEQ ID NO: 153003 - DNA, 5188 bp, Homo sapiens
  Payload ID: 10099
  Gene Symbol: MIER3
  Gene Name: mesoderm induction early response 1, family member 3
  Uniprot ID: Q7Z3K6
  ENST ID: ENST00000381199
  CDS Start-End: 12-1664
aaggtaccaatatggcggaggcttcttttggaagttcgagcccagttgggtctttgtcttctgaggatcatgattttgaccccactgctgagatgttggtccatgactatgatgatgaaagaactcttgaagaagaggaaatgatggatgagggtaaaaacttcagttcagaaattgaagacttagaaaaggaaggaaccatgcctctagaagatttactggcattctatggctatgaacctacaattccagcagttgcaaattccagtgcaaatagttccccaagtgaactggcagatgaactaccagacatgacactagacaaagaggaaatagcaaaagacctgttgtcaggtgatgacgaggaaactcagtcttctgcggatgatctgacgccatctgtgacttcccatgaaacttctgatttcttccctaggcctttacgatcaaatactgcatgtgatggtgataaggaatcagaggttgaagatgttgaaacagacagtggtaattcacctgaagatttgaggaaggaaataatgattggtttacaatatcaggcagagattcccccttatcttggagagtacgatggtaatgagaaagtatatgaaaacgaagaccagttactttggtgtcctgatgtggttttggagagcaaagttaaggaataccttgttgagacttcattaaggactggcagtgaaaaaataatggataggatttctgcaggaacacacacaagggacaatgaacaggcattatatgaacttctcaagtgtaaccacaatataaaggaagcaatcgaaagatactgctgcaatggaaaggcctctcaagaaggaatgactgcatggacggaagaagaatgccgaagctttgaacatgcactcatgctttttggaaaagattttcatcttatacagaagaataaggtgagaactaggacagttgctgagtgtgtagcattctactatatgtggaagaaatctgaacgttatgattactttgctcaacagacaagatttgggaaaaaaagatataaccatcaccctggagttacggactatatggatcgtttagtagatgaaacagaagctttgggtgggacggtaaatgcttcagccttaacttctaaccggcctgagcctattcctgatcaacagctaaacattctcaactccttcactgccagtgacttgacagctttgaccaacagtgtagcaaccgtctgcgaccccacagatgtgaattgtttggatgatagctttcctccactgggcaacacaccccgtggacaagttaatcatgtgcctgttgtaacagaagagttactcaccctgcccagcaatggggaaagtgattgttttaatttatttgagactggattttatcactcggagctaaaccctatgaacatgtgcagtgaagagtcagagagaccagcaaaaagattgaaaatgggcattgccgtccctgaatcctttatgaatgaagtttctgtaaataacctgggtgtggactttgaaaatcacacacatcacatcaccagtgccaaaatggctgtttctgtggctgactttggcagtctctctgccaacgagaccaatggtttcatcagtgcccatgctctgcatcagcacgcggccctacactctgagtgacctgagtgaggatcccggaactgcgtgtgcagcaccagtaaacttgaggggagctatcaggtttgcatagtctttcactggaagtttgaacctttctcactatgacatcagtgatgtcagtatgtatagaactatatcttgatttatcaagagtattttcatttttcaatccataaatgtggaaatgaactatgatcagcagagttgggaactaagattgaactctgtggtgcagctttaagctctgcttctctcttcctcatctcccaatacctcttccccactcccttctttttctattcttttgtgttccccactgccctcactcccaattttaaaacctgtagacagaggccaccagctcaaaaccagcacagatgttctgaactgaatggtgtggcctgtttttgtgtaaattccttttgccgtaatggatgcagtggaataacaatgtttacaggtaccgatcccgatccctgctcaatgtagcatttttttggttttattttcttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatgttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttactagttgctttgcaaaaaacaaatgtttggctgcattgctaatatttgtaagtataagttgcttcaaggttgtgctgatgagtagataggatgtagtgatcttagtagtgattgaaagggagggtatttattatacaaactgtgaactgcaatgacatccttagttttggatgatgtgtattcttgtttttctttgcagcattttaatgaagattgctttgaagtgtttacgcagtagcacattagtataaaatttagtttagcacagtggacaaaaagtagttaaattaataacttaaaatcagtctctaatttatacatctgaagtatagcattcctgtatgcacacagtaaataatgggtagcctgggctctgtgttactttcttgtatttttatccaagttgtcagcttcttattgctgtgttgttgtgctaaactttgaaccttatttcttttattaaaaatcagtacactttctataatttagtaagatactggccataatcttccattgttataaccttaattttcactctgggtttacagtggctggtctgtataaataatttacacaaagatgactgaatgctaataccagttgcacttaaatgaacatgcccattctcagtagctgatgcagtaatatattcagtttatctatgcattgctggggtcttgatataagatggaaacagtgtttcttatctaaagttttgattatcagcaagttgaatggacactttagttatttaaataaagatttttgaccaaaatccagaaaatggtatgagagaaaaataaattccagctagtttaatagatttttaaatgtcaatctgattttagcctcttagagagtgctaactagctggtaatgtttacttttaattccttgttaaaatgaggcaataatttgcaagatttttgtatataagtgtaaattcttcatatctttttagatctaattcaatattttctgactacttctgccatgtataataccatttttgtgcatgcttgatgtgacattcataaattgtaccactatgactttatccatgtaaaatagctatttattgaattttcttttaaaagctggatttactgggttttttttttctctcagtttaaacatcttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttcactaaatggaggaaactattagttttattgttaaatatggtagatattaatattcctcttagatgaccagtgattccaattgtcccagtttgaaataagtaccctgtgagtatgagataaattagtgacaatcagaacaagtttcagtatcagatgttcaagaggaagttgctattgcattgattttaatatttgtacataaacactgatttttttgagcattattttgtatttgttgtactttaatacctggtgtacagttccagaaataaaaatctgggaatctt

SEQ ID NO: 153004 - DNA, 5198 bp, Homo sapiens
  Payload ID: 10099
  Gene Symbol: MIER3
  Gene Name: mesoderm induction early response 1, family member 3
  Uniprot ID: Q7Z3K6
  ENST ID: ENST00000381213
  CDS Start-End: 24-1673
tcgttcgccctaaaggtaccaatatggcggaggcttcttttggaagttcgagcccagttgggtctttgtcttctgaggatcatgattttgaccccactgctgagatgttggtccatgactatgatgatgaaagaactcttgaagaagaggaaatgatggatgagggtaaaaacttcagttcagaaattgaagacttagaaaaggaaggaaccatgcctctagaagatttactggcattctatggctatgaacctacaattccagcagttgcaaattccagtgcaaatagttccccaagtgaactggcagatgaactaccagacatgacactagacaaagaggaaatagcaaaagacctgttgtcaggtgatgacgaggaaactcagtcttctgcggatgatctgacgccatctgtgacttcccatgaaacttctgatttcttccctaggcctttacgatcaaatactgcatgtgatggtgataaggaatcagaggttgaagatgttgaaacagacagtggtaattcacctgaagatttgaggaaggaaataatgattggtttacaatatcaggcagagattcccccttatcttggagagtacgatggtaatgagaaagtatatgaaaacgaagaccagttactttggtgtcctgatgtggttttggagagcaaagttaaggaataccttgttgagacttcattaaggactggcagtgaaaaaataatggataggatttctgcaggaacacacacaagggacaatgaacaggcattatatgaacttctcaagtgtaaccacaatataaaggaagcaatcgaaagatactgctgcaatggaaaggcctctcaaggaatgactgcatggacggaagaagaatgccgaagctttgaacatgcactcatgctttttggaaaagattttcatcttatacagaagaataaggtgagaactaggacagttgctgagtgtgtagcattctactatatgtggaagaaatctgaacgttatgattactttgctcaacagacaagatttgggaaaaaaagatataaccatcaccctggagttacggactatatggatcgtttagtagatgaaacagaagctttgggtgggacggtaaatgcttcagccttaacttctaaccggcctgagcctattcctgatcaacagctaaacattctcaactccttcactgccagtgacttgacagctttgaccaacagtgtagcaaccgtctgcgaccccacagatgtgaattgtttggatgatagctttcctccactgggcaacacaccccgtggacaagttaatcatgtgcctgttgtaacagaagagttactcaccctgcccagcaatggggaaagtgattgttttaatttatttgagactggattttatcactcggagctaaaccctatgaacatgtgcagtgaagagtcagagagaccagcaaaaagattgaaaatgggcattgccgtccctgaatcctttatgaatgaagtttctgtaaataacctgggtgtggactttgaaaatcacacacatcacatcaccagtgccaaaatggctgtttctgtggctgactttggcagtctctctgccaacgagaccaatggtttcatcagtgcccatgctctgcatcagcacgcggccctacactctgagtgacctgagtgaggatcccggaactgcgtgtgcagcaccagtaaacttgaggggagctatcaggtttgcatagtctttcactggaagtttgaacctttctcactatgacatcagtgatgtcagtatgtatagaactatatcttgatttatcaagagtattttcatttttcaatccataaatgtggaaatgaactatgatcagcagagttgggaactaagattgaactctgtggtgcagctttaagctctgcttctctcttcctcatctcccaatacctcttccccactcccttctttttctattcttttgtgttccccactgccctcactcccaattttaaaacctgtagacagaggccaccagctcaaaaccagcacagatgttctgaactgaatggtgtggcctgtttttgtgtaaattccttttgccgtaatggatgcagtggaataacaatgtttacaggtaccgatcccgatccctgctcaatgtagcatttttttggttttattttcttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatgttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttactagttgctttgcaaaaaacaaatgtttggctgcattgctaatatttgtaagtataagttgcttcaaggttgtgctgatgagtagataggatgtagtgatcttagtagtgattgaaagggagggtatttattatacaaactgtgaactgcaatgacatccttagttttggatgatgtgtattcttgtttttctttgcagcattttaatgaagattgctttgaagtgtttacgcagtagcacattagtataaaatttagtttagcacagtggacaaaaagtagttaaattaataacttaaaatcagtctctaatttatacatctgaagtatagcattcctgtatgcacacagtaaataatgggtagcctgggctctgtgttactttcttgtatttttatccaagttgtcagcttcttattgctgtgttgttgtgctaaactttgaaccttatttcttttattaaaaatcagtacactttctataatttagtaagatactggccataatcttccattgttataaccttaattttcactctgggtttacagtggctggtctgtataaataatttacacaaagatgactgaatgctaataccagttgcacttaaatgaacatgcccattctcagtagctgatgcagtaatatattcagtttatctatgcattgctggggtcttgatataagatggaaacagtgtttcttatctaaagttttgattatcagcaagttgaatggacactttagttatttaaataaagatttttgaccaaaatccagaaaatggtatgagagaaaaataaattccagctagtttaatagatttttaaatgtcaatctgattttagcctcttagagagtgctaactagctggtaatgtttacttttaattccttgttaaaatgaggcaataatttgcaagatttttgtatataagtgtaaattcttcatatctttttagatctaattcaatattttctgactacttctgccatgtataataccatttttgtgcatgcttgatgtgacattcataaattgtaccactatgactttatccatgtaaaatagctatttattgaattttcttttaaaagctggatttactgggttttttttttctctcagtttaaacatcttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttcactaaatggaggaaactattagttttattgttaaatatggtagatattaatattcctcttagatgaccagtgattccaattgtcccagtttgaaataagtaccctgtgagtatgagataaattagtgacaatcagaacaagtttcagtatcagatgttcaagaggaagttgctattgcattgattttaatatttgtacataaacactgatttttttgagcattattttgtatttgttgtactttaatacctggtgtacagttccagaaataaaaatctgggaatcttt

SEQ ID NO: 153005 - DNA, 5210 bp, Homo sapiens
  Payload ID: 10099
  Gene Symbol: MIER3
  Gene Name: mesoderm induction early response 1, family member 3
  Uniprot ID: Q7Z3K6
  ENST ID: ENST00000381226
  CDS Start-End: 17-1684
ccctaaaggtaccaatatggcggaggcttcttttggaagttcgagcccagtttgttttattccagttgggtctttgtcttctgaggatcatgattttgaccccactgctgagatgttggtccatgactatgatgatgaaagaactcttgaagaagaggaaatgatggatgagggtaaaaacttcagttcagaaattgaagacttagaaaaggaaggaaccatgcctctagaagatttactggcattctatggctatgaacctacaattccagcagttgcaaattccagtgcaaatagttccccaagtgaactggcagatgaactaccagacatgacactagacaaagaggaaatagcaaaagacctgttgtcaggtgatgacgaggaaactcagtcttctgcggatgatctgacgccatctgtgacttcccatgaaacttctgatttcttccctaggcctttacgatcaaatactgcatgtgatggtgataaggaatcagaggttgaagatgttgaaacagacagtggtaattcacctgaagatttgaggaaggaaataatgattggtttacaatatcaggcagagattcccccttatcttggagagtacgatggtaatgagaaagtatatgaaaacgaagaccagttactttggtgtcctgatgtggttttggagagcaaagttaaggaataccttgttgagacttcattaaggactggcagtgaaaaaataatggataggatttctgcaggaacacacacaagggacaatgaacaggcattatatgaacttctcaagtgtaaccacaatataaaggaagcaatcgaaagatactgctgcaatggaaaggcctctcaagaaggaatgactgcatggacggaagaagaatgccgaagctttgaacatgcactcatgctttttggaaaagattttcatcttatacagaagaataaggtgagaactaggacagttgctgagtgtgtagcattctactatatgtggaagaaatctgaacgttatgattactttgctcaacagacaagatttgggaaaaaaagatataaccatcaccctggagttacggactatatggatcgtttagtagatgaaacagaagctttgggtgggacggtaaatgcttcagccttaacttctaaccggcctgagcctattcctgatcaacagctaaacattctcaactccttcactgccagtgacttgacagctttgaccaacagtgtagcaaccgtctgcgaccccacagatgtgaattgtttggatgatagctttcctccactgggcaacacaccccgtggacaagttaatcatgtgcctgttgtaacagaagagttactcaccctgcccagcaatggggaaagtgattgttttaatttatttgagactggattttatcactcggagctaaaccctatgaacatgtgcagtgaagagtcagagagaccagcaaaaagattgaaaatgggcattgccgtccctgaatcctttatgaatgaagtttctgtaaataacctgggtgtggactttgaaaatcacacacatcacatcaccagtgccaaaatggctgtttctgtggctgactttggcagtctctctgccaacgagaccaatggtttcatcagtgcccatgctctgcatcagcacgcggccctacactctgagtgacctgagtgaggatcccggaactgcgtgtgcagcaccagtaaacttgaggggagctatcaggtttgcatagtctttcactggaagtttgaacctttctcactatgacatcagtgatgtcagtatgtatagaactatatcttgatttatcaagagtattttcatttttcaatccataaatgtggaaatgaactatgatcagcagagttgggaactaagattgaactctgtggtgcagctttaagctctgcttctctcttcctcatctcccaatacctcttccccactcccttctttttctattcttttgtgttccccactgccctcactcccaattttaaaacctgtagacagaggccaccagctcaaaaccagcacagatgttctgaactgaatggtgtggcctgtttttgtgtaaattccttttgccgtaatggatgcagtggaataacaatgtttacaggtaccgatcccgatccctgctcaatgtagcatttttttggttttattttcttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatgttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttactagttgctttgcaaaaaacaaatgtttggctgcattgctaatatttgtaagtataagttgcttcaaggttgtgctgatgagtagataggatgtagtgatcttagtagtgattgaaagggagggtatttattatacaaactgtgaactgcaatgacatccttagttttggatgatgtgtattcttgtttttctttgcagcattttaatgaagattgctttgaagtgtttacgcagtagcacattagtataaaatttagtttagcacagtggacaaaaagtagttaaattaataacttaaaatcagtctctaatttatacatctgaagtatagcattcctgtatgcacacagtaaataatgggtagcctgggctctgtgttactttcttgtatttttatccaagttgtcagcttcttattgctgtgttgttgtgctaaactttgaaccttatttcttttattaaaaatcagtacactttctataatttagtaagatactggccataatcttccattgttataaccttaattttcactctgggtttacagtggctggtctgtataaataatttacacaaagatgactgaatgctaataccagttgcacttaaatgaacatgcccattctcagtagctgatgcagtaatatattcagtttatctatgcattgctggggtcttgatataagatggaaacagtgtttcttatctaaagttttgattatcagcaagttgaatggacactttagttatttaaataaagatttttgaccaaaatccagaaaatggtatgagagaaaaataaattccagctagtttaatagatttttaaatgtcaatctgattttagcctcttagagagtgctaactagctggtaatgtttacttttaattccttgttaaaatgaggcaataatttgcaagatttttgtatataagtgtaaattcttcatatctttttagatctaattcaatattttctgactacttctgccatgtataataccatttttgtgcatgcttgatgtgacattcataaattgtaccactatgactttatccatgtaaaatagctatttattgaattttcttttaaaagctggatttactgggttttttttttctctcagtttaaacatcttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttcactaaatggaggaaactattagttttattgttaaatatggtagatattaatattcctcttagatgaccagtgattccaattgtcccagtttgaaataagtaccctgtgagtatgagataaattagtgacaatcagaacaagtttcagtatcagatgttcaagaggaagttgctattgcattgattttaatatttgtacataaacactgatttttttgagcattattttgtatttgttgtactttaatacctggtgtacagttccagaaataaaaatctgggaatctttt

SEQ ID NO: 153006 - DNA, 2152 bp, Homo sapiens
  Payload ID: 10099
  Gene Symbol: MIER3
  Gene Name: mesoderm induction early response 1, family member 3
  Uniprot ID: Q7Z3K6
  ENST ID: ENST00000409421
  CDS Start-End: 145-1608
aagactgaattccttgtgagcagggattcttcagtaaatttcatttgtatgtccagtagcaagtagctagtagccctcagccaagcacttagaactgagtaaatgatgggaaggtggaccatcagtgcataaaaggaaggaaccatgcctctagaagatttactggcattctatggctatgaacctacaattccagcagttgcaaattccagtgcaaatagttccccaagtgaactggcagatgaactaccagacatgacactagacaaagaggaaatagcaaaagacctgttgtcaggtgatgacgaggaaactcagtcttctgcggatgatctgacgccatctgtgacttcccatgaaacttctgatttcttccctaggcctttacgatcaaatactgcatgtgatggtgataaggaatcagaggttgaagatgttgaaacagacagtggtaattcacctgaagatttgaggaaggaaataatgattggtttacaatatcaggcagagattcccccttatcttggagagtacgatggtaatgagaaagtatatgaaaacgaagaccagttactttggtgtcctgatgtggttttggagagcaaagttaaggaataccttgttgagacttcattaaggactggcagtgaaaaaataatggataggatttctgcaggaacacacacaagggacaatgaacaggcattatatgaacttctcaagtgtaaccacaatataaaggaagcaatcgaaagatactgctgcaatggaaaggcctctcaagaaggaatgactgcatggacggaagaagaatgccgaagctttgaacatgcactcatgctttttggaaaagattttcatcttatacagaagaataaggtgagaactaggacagttgctgagtgtgtagcattctactatatgtggaagaaatctgaacgttatgattactttgctcaacagacaagatttgggaaaaaaagatataaccatcaccctggagttacggactatatggatcgtttagtagatgaaacagaagctttgggtgggacggtaaatgcttcagccttaacttctaaccggcctgagcctattcctgatcaacagctaaacattctcaactccttcactgccagtgacttgacagctttgaccaacagtgtagcaaccgtctgcgaccccacagatgtgaattgtttggatgatagctttcctccactgggcaacacaccccgtggacaagttaatcatgtgcctgttgtaacagaagagttactcaccctgcccagcaatggggaaagtgattgttttaatttatttgagactggattttatcactcggagctaaaccctatgaacatgtgcagtgaagagtcagagagaccagcaaaaagattgaaaatgggcattgccgtccctgaatcctttatgaatgaagtttctgtaaataacctgggtgtggactttgaaaatcacacacatcacatcaccagtgccaaaatggctgtttctgtggctgactttggcagtctctctgccaacgagaccaatggtttcatcagtgcccatgctctgcatcagcacgcggccctacactctgagtgacctgagtgaggatcccggaactgcgtgtgcagcaccagtaaacttgaggggagctatcaggtttgcatagtctttcactggaagtttgaacctttctcactatgacatcagtgatgtcagtatgtatagaactatatcttgatttatcaagagtattttcatttttcaatccataaatgtggaaatgaactatgatcagcagagttgggaactaagattgaactctgtggtgcagctttaagctctgcttctctcttcctcatctcccaatacctcttccccactcccttctttttctattcttttgtgttccccactgccctcactcccaattttaaaacctgtagacagaggccaccagctcaaaaccagcacagatgttctgaactgaatggtgtggcctgtttttgtgtaaattccttttgccgtaatggatgcagtggaataacaatgtttacaggtaccgatcccgatccctgctcaatgtagcatttttttggttttattttcttaataaaagcaggggtaggtttctttaaactgc

SEQ ID NO: 153007 - DNA, 304 bp, Homo sapiens
  Payload ID: 10099
  Gene Symbol: MIER3
  Gene Name: mesoderm induction early response 1, family member 3
  ENST ID: ENST00000451637
  CDS Start-End: 1-134
aacctacaattccagcagttgcaaattccagtgcaaatagttccccaagtgaactggcagatgaactaccagacatgacactagacaaaatctcaggcagggagaggaatccacatcttggaacctcttcctgaggaaatagcaaaagacctgttgtcaggtgatgacgaggaaactcagtcttctgcggatgatctgacgccatctgtgacttcccatgaaacttctgatttcttccctaggcctttacgatgctcctgctctcctggttttgaaaacttatcagtgctcaaaagcaaatact

SEQ ID NO: 153008 - DNA, 219 bp, Homo sapiens
  Payload ID: 10099
  Gene Symbol: MIER3
  Gene Name: mesoderm induction early response 1, family member 3
  ENST ID: ENST00000440000
  CDS Start-End: 148-219
tgacaagaatgacagcacaaccacagcaattaccaatttagagagttacactcaacgcagcaagatgttcacactaggagaagccaaacaagagtacagaagattcaagtctgccatctcatgctaaacctggagcatatcctttgaatggaatggagaacagaggcactggcatcccttgggtctttgtcttctgaggatcatgattttgaccccact

SEQ ID NO: 153009 - DNA, 5240 bp, Homo sapiens
  Payload ID: 10099
  Gene Symbol: MIER3
  Gene Name: mesoderm induction early response 1, family member 3
  Uniprot ID: Q7Z3K6
  ENST ID: ENST00000452157
  CDS Start-End: 21-380
ttcgccctaaaggtaccaatatggcggaggcttcttttggaagttcgagcccagttgggtctttgtcttctgaggatcatgattttgaccccactgctgagatgttggtccatgactatgatgatgaaagaactcttgaagaagaggaaatgatggatgagggtaaaaacttcagttcagaaattgaagacttagaaaaggaaggaaccatgcctctagaagatttactggcattctatggctatgaacctacaattccagcagttgcaaattccagtgcaaatagttccccaagtgaactggcagatgaactaccagacatgacactagacaaaatctcaggcagggagaggaatccacatcttggaacctcttcctgaggaaatagcaaaagacctgttgtcaggtgatgacgaggaaactcagtcttctgcggatgatctgacgccatctgtgacttcccatgaaacttctgatttcttccctaggcctttacgatcaaatactgcatgtgatggtgataaggaatcagaggttgaagatgttgaaacagacagtggtaattcacctgaagatttgaggaaggaaataatgattggtttacaatatcaggcagagattcccccttatcttggagagtacgatggtaatgagaaagtatatgaaaacgaagaccagttactttggtgtcctgatgtggttttggagagcaaagttaaggaataccttgttgagacttcattaaggactggcagtgaaaaaataatggataggatttctgcaggaacacacacaagggacaatgaacaggcattatatgaacttctcaagtgtaaccacaatataaaggaagcaatcgaaagatactgctgcaatggaaaggcctctcaagaaggaatgactgcatggacggaagaagaatgccgaagctttgaacatgcactcatgctttttggaaaagattttcatcttatacagaagaataaggtgagaactaggacagttgctgagtgtgtagcattctactatatgtggaagaaatctgaacgttatgattactttgctcaacagacaagatttgggaaaaaaagatataaccatcaccctggagttacggactatatggatcgtttagtagatgaaacagaagctttgggtgggacggtaaatgcttcagccttaacttctaaccggcctgagcctattcctgatcaacagctaaacattctcaactccttcactgccagtgacttgacagctttgaccaacagtgtagcaaccgtctgcgaccccacagatgtgaattgtttggatgatagctttcctccactgggcaacacaccccgtggacaagttaatcatgtgcctgttgtaacagaagagttactcaccctgcccagcaatggggaaagtgattgttttaatttatttgagactggattttatcactcggagctaaaccctatgaacatgtgcagtgaagagtcagagagaccagcaaaaagattgaaaatgggcattgccgtccctgaatcctttatgaatgaagtttctgtaaataacctgggtgtggactttgaaaatcacacacatcacatcaccagtgccaaaatggctgtttctgtggctgactttggcagtctctctgccaacgagaccaatggtttcatcagtgcccatgctctgcatcagcacgcggccctacactctgagtgacctgagtgaggatcccggaactgcgtgtgcagcaccagtaaacttgaggggagctatcaggtttgcatagtctttcactggaagtttgaacctttctcactatgacatcagtgatgtcagtatgtatagaactatatcttgatttatcaagagtattttcatttttcaatccataaatgtggaaatgaactatgatcagcagagttgggaactaagattgaactctgtggtgcagctttaagctctgcttctctcttcctcatctcccaatacctcttccccactcccttctttttctattcttttgtgttccccactgccctcactcccaattttaaaacctgtagacagaggccaccagctcaaaaccagcacagatgttctgaactgaatggtgtggcctgtttttgtgtaaattccttttgccgtaatggatgcagtggaataacaatgtttacaggtaccgatcccgatccctgctcaatgtagcatttttttggttttattttcttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatgttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttactagttgctttgcaaaaaacaaatgtttggctgcattgctaatatttgtaagtataagttgcttcaaggttgtgctgatgagtagataggatgtagtgatcttagtagtgattgaaagggagggtatttattatacaaactgtgaactgcaatgacatccttagttttggatgatgtgtattcttgtttttctttgcagcattttaatgaagattgctttgaagtgtttacgcagtagcacattagtataaaatttagtttagcacagtggacaaaaagtagttaaattaataacttaaaatcagtctctaatttatacatctgaagtatagcattcctgtatgcacacagtaaataatgggtagcctgggctctgtgttactttcttgtatttttatccaagttgtcagcttcttattgctgtgttgttgtgctaaactttgaaccttatttcttttattaaaaatcagtacactttctataatttagtaagatactggccataatcttccattgttataaccttaattttcactctgggtttacagtggctggtctgtataaataatttacacaaagatgactgaatgctaataccagttgcacttaaatgaacatgcccattctcagtagctgatgcagtaatatattcagtttatctatgcattgctggggtcttgatataagatggaaacagtgtttcttatctaaagttttgattatcagcaagttgaatggacactttagttatttaaataaagatttttgaccaaaatccagaaaatggtatgagagaaaaataaattccagctagtttaatagatttttaaatgtcaatctgattttagcctcttagagagtgctaactagctggtaatgtttacttttaattccttgttaaaatgaggcaataatttgcaagatttttgtatataagtgtaaattcttcatatctttttagatctaattcaatattttctgactacttctgccatgtataataccatttttgtgcatgcttgatgtgacattcataaattgtaccactatgactttatccatgtaaaatagctatttattgaattttcttttaaaagctggatttactgggttttttttttctctcagtttaaacatcttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttcactaaatggaggaaactattagttttattgttaaatatggtagatattaatattcctcttagatgaccagtgattccaattgtcccagtttgaaataagtaccctgtgagtatgagataaattagtgacaatcagaacaagtttcagtatcagatgttcaagaggaagttgctattgcattgattttaatatttgtacataaacactgatttttttgagcattattttgtatttgttgtactttaatacctggtgtacagttccagaaataaaaatctgggaatctt

SEQ ID NO: 153010 - DNA, 4818 bp, Homo sapiens
  Payload ID: 10100
  Gene Symbol: MIER1
  Gene Name: mesoderm induction early response 1, transcriptional regulator
  Uniprot ID: Q8N108
  ENST ID: ENST00000355356
  CDS Start-End: 150-1688
gcggctcctgcgcgttcccgccgaggcagtggcggcgggagcggcagagacggcagcggccggagtcccgttgctgagtctcacatccgggttctggccgtgacccagctgcggccgccgcggagatgtgacccggcagtacggcaaatatggcggagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattggaaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaat

SEQ ID NO: 153011 - DNA, 3595 bp, Homo sapiens
  Payload ID: 10100
  Gene Symbol: MIER1
  Gene Name: mesoderm induction early response 1, transcriptional regulator
  Uniprot ID: Q8N108
  ENST ID: ENST00000355977
  CDS Start-End: 337-1449
aggagggcggaggcggaggggagggcagagggttggtggagctggaggaagctccggacgacgactggaagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgccatctgttgaatcttcaagtccaggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattggaaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaatattttctttgctatcgatggataattaggagtgggcacttggaataactgagggctggtgaatataataggcaatatttacatggggtgtgtaactaaataccaaatcagatagtaaggttttcccaactataatccatattcatgaaaaatgccagtgtggaaaaccatgtaacatacagaagaacaggagtttccaaattttaaccttttattctaaaaatgactctcttctctcaaaatgactttttctgtatcacataattctactgatacaactttttaccgtaaaaattaactctcttctttaatatcaagttcatcctttgcagaatcttaaagggttttccacacatccatccacccacttacagactgatttcatgtatctgaatatctgattaacctttcttttctaataccagttttccataaactcttgtcatgtacccttagtattgtgctgatcttttgccaactatacggacgtggagtttttccttttcagaatatgattattttcaatttgtctttagttagtataaagaattatagaatgtataatgtaattaaaatgtcattttgcttgc

SEQ ID NO: 153012 - DNA, 4978 bp, Homo sapiens
  Payload ID: 10100
  Gene Symbol: MIER1
  Gene Name: mesoderm induction early response 1, transcriptional regulator
  Uniprot ID: Q8N108
  ENST ID: ENST00000357692
  CDS Start-End: 258-1847
gactggaagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgtagaaaatgtgcatcagatgtttatgtttaattggtttacagactgtctgtggactcttttcctgtcaaattaccagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattggaaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaata

SEQ ID NO: 153013 - DNA, 2420 bp, Homo sapiens
  Payload ID: 10100
  Gene Symbol: MIER1
  Gene Name: mesoderm induction early response 1, transcriptional regulator
  Uniprot ID: Q8N108
  ENST ID: ENST00000371012
  CDS Start-End: 245-490
aggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgaaaatgtgcatcagatgtttatgtttaattggtttacagactgtctgtggactcttttcctgtcaaattaccagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggtaaataacatgtagagctagggtatgaattggttatgacttttttgtggaaagggaagatctgaaattttgattctctgattaggagagaaattgtgttatatattaatgactgaaaaattttgtgtgatcataggtgggatatttaaagtttgaaatgaaaggatttaaaaacaataactttattatgtgcaataacagaattcacatagttactttggtaaaacatagactgttaaatgattctgctataaaggtctggtcaaaaatggactataaaaggattctacacggcctcatatatcctttgtccttccccagttaccatatcttttacttattctccttcagagccaaaaattcttgaagtatcattttccattcactacataaagtgctctagattatctccactacataaagtgctctagattatctccacctcttcctatcaaggtgaccagtgaactttccttgttacatccatttttatattcacttttctctcactaccttactttttctcagcagtattcaatatagtttaacattcccttcttttacttgaattctggagtacaccactgtctggttttctttatctttttgtttctattcagtatcttttgcagactcttcttccgttactcaaggtttacatgttggcagtttgtgattctcagtttggaccttctttttttctctcctgtctctgtctggatcagtgctcctcaaaatgtagtatgagggtcagttgcatcagaatcaaccctgtacttattttaaaaagcagattttttggacctctcccccggcatactgaatcagaatctctggaggtggtgttcagatccacatcttcattaagtaagttggcattatatgtacaccaaatttgaaaatcactaagctgtgtgatttaatttattcccttggtgtgtatatccttagtattctttagtttatatttctagcattaacctatttcctgtctccagttttgtttgtccaccttgacatttctgcttgcttaactaaatggacatctctaaattataaatgtccaaaacagaactattgactgttgtttttttctctgcttgttctttccctgtcctatcagtaaaaagtggtactactatttaccctgttgcctaagtcagaaaccagtgagtcattttccttctctttcaatatcttatttctaaataaacctatcatttgtatccacaagaatatcccttagccgactcttgatccattgctgcctagattaccattctttctagcctaggctattgcagtagcttcctgactggtttccccatttcctcttttaccatctttctcctgatacatttccacccagcagctgtgatcttcttttcaaaatgtaaatcaattaatatcaacctcccagcttcctgttatatccaaagaaaacccaaactcctcaaccaggccagcaaggccacctgcatgataatggcctcttacccatgtatcacactacctctgttatagccacactagctgcttttgttgttaaataggctagtttcttctgcttcaagggttttcagctcattctcactctctggtatatgcatcccaaggccggctccttatcctctgggttcggtgttgcctcctcagaatagcagcctttcctgtcccctaattaggttttaattagttttttgttttatttttatttttttttaaccactgtcccctattcaatgctttctttagtgttaggacacaatttgtaattgtttgtttaatttattgtctgtacctccactggttttgagaagatgaaataaaatgactgttattcaccagtgtatttcatggtaccttgcaagagtgctcactcaaaagtattgtatgaatgaatggatatatcagtctggtatgttctaataaaatatatcatgca

SEQ ID NO: 153014 - DNA, 1728 bp, Homo sapiens
  Payload ID: 10100
  Gene Symbol: MIER1
  Gene Name: mesoderm induction early response 1, transcriptional regulator
  Uniprot ID: Q8N108
  ENST ID: ENST00000371014
  CDS Start-End: 71-1531
ctggaagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcat

SEQ ID NO: 153015 - DNA, 1802 bp, Homo sapiens
  Payload ID: 10100
  Gene Symbol: MIER1
  Gene Name: mesoderm induction early response 1, transcriptional regulator
  Uniprot ID: Q8N108
  ENST ID: ENST00000371016
  CDS Start-End: 253-1605
ctggaagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgaaaatgtgcatcagatgtttatgtttaattggtttacagactgtctgtggactcttttcctgtcaaattaccagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcat

SEQ ID NO: 153016 - DNA, 3875 bp, Homo sapiens
  Payload ID: 10100
  Gene Symbol: MIER1
  Gene Name: mesoderm induction early response 1, transcriptional regulator
  Uniprot ID: Q8N108
  ENST ID: ENST00000371018
  CDS Start-End: 317-1729
aggagggcggaggcggaggggagggcagagggttggtggagctggaggaagctccggacgacgactggaagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgaaaatgtgcatcagatgtttatgtttaattggtttacagactgtctgtggactcttttcctgtcaaattaccagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattggaaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaatattttctttgctatcgatggataattaggagtgggcacttggaataactgagggctggtgaatataataggcaatatttacatggggtgtgtaactaaataccaaatcagatagtaaggttttcccaactataatccatattcatgaaaaatgccagtgtggaaaaccatgtaacatacagaagaacaggagtttccaaattttaaccttttattctaaaaatgactctcttctctcaaaatgactttttctgtatcacataattctactgatacaactttttaccgtaaaaattaactctcttctttaatatcaagttcatcctttgcagaatcttaaagggttttccacacatccatccacccacttacagactgatttcatgtatctgaatatctgattaacctttcttttctaataccagttttccataaactcttgtcatgtacccttagtattgtgctgatcttttgccaactatacggacgtggagtttttccttttcagaatatgattattttcaatttgtctttagttagtataaagaattatagaatgtataatgtaattaaaatgtcattttgcttgc

SEQ ID NO: 153017 - DNA, 2552 bp, Homo sapiens
  Payload ID: 10100
  Gene Symbol: MIER1
  Gene Name: mesoderm induction early response 1, transcriptional regulator
  Uniprot ID: Q8N108
  ENST ID: ENST00000401041
  CDS Start-End: 71-1768
ctggaagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaat

SEQ ID NO: 153018 - DNA, 1648 bp, Homo sapiens
  Payload ID: 10100
  Gene Symbol: MIER1
  Gene Name: mesoderm induction early response 1, transcriptional regulator
  Uniprot ID: Q8N108
  ENST ID: ENST00000401042
  CDS Start-End: 150-1451
gcggctcctgcgcgttcccgccgaggcagtggcggcgggagcggcagagacggcagcggccggagtcccgttgctgagtctcacatccgggttctggccgtgacccagctgcggccgccgcggagatgtgacccggcagtacggcaaatatggcggagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcat

SEQ ID NO: 153019 - DNA, 2369 bp, Homo sapiens
  Payload ID: 10101
  Gene Symbol: MESP1
  Gene Name: mesoderm posterior bHLH transcription factor 1
  Uniprot ID: Q9BRJ9
  ENST ID: ENST00000300057
  CDS Start-End: 80-886
ctggaaggggccacttcacacctcgggctcggcataaagcggccgccggccgccggcccccagacgcgccgccgctgccatggcccagcccctgtgcccgccgctctccgagtcctggatgctctctgcggcctggggcccaactcggcggccgccgccctccgacaaggactgcggccgctccctcgtctcgtccccagactcatggggcagcaccccagccgacagccccgtggcgagccccgcgcggccaggcaccctccgggacccccgcgccccctccgtaggtaggcgcggcgcgcgcagcagccgcctgggcagcgggcagaggcagagcgccagtgagcgggagaaactgcgcatgcgcacgctggcccgcgccctgcacgagctgcgccgctttctaccgccgtccgtggcgcccgcgggccagagcctgaccaagatcgagacgctgcgcctggctatccgctatatcggccacctgtcggccgtgctaggcctcagcgaggagagtctccagcgccggtgccggcagcgcggtgacgcggggtcccctcggggctgcccgctgtgccccgacgactgccccgcgcagatgcagacacggacgcaggctgaggggcaggggcaggggcgcgggctgggcctggtatccgccgtccgcgccggggcgtcctggggatccccgcctgcctgccccggagcccgagctgcacccgagccgcgcgacccgcctgcgctgttcgccgaggcggcgtgccctgaagggcaggcgatggagccaagcccaccgtccccgctccttccgggcgacgtgctggctctgttggagacctggatgcccctctcgcctctggagtggctgcctgaggagcccaagtgacaagggacaactgacgccgtctctgtgagcaccgaggctttttggcctcagcaccttcgaagtggttccttggcagactgcctttcctggaagagggcacgggcgatcccgacgggggcattcctgcgggtgagagccgtccccaccgcggcggcccttctcagcccctccctccatggagggacccatagggctagacactttgaggcaagcaggaggctctgcctaatgtgaatttatttatttgtgaataaactgtactggtgtcagttggcaatttcttcttcctacccgtggacacagagctccctctctccctccaaagaagagcatgggagaggtgggaggggttcttgcaatctttagccccccgacccccacaggcccagacccctttggccttacccccagccctggctcagcatctagtccagatgggtcagcctggaatgggtggggagggacgtcctgtgagaaggcagcggcaagtagaatctgctcatcttttctttgaacctggtggggaactggttaaaaccaaaatatctgtgtagaaatacaactccattattgagtatttattgtatgtacatcaggtacctattatactcaagtaaccattttacagaaggatgaggatcagcgctcaagcccaggtaggcctccagagtcccagcgctcagctcttgtgggattttgccagctccatacatgttggggcctgagggataacagctccaaggggttattttcttgcatcctgtggtcttattctccatgcacgggagcatcctggccttggaactcccccaccctccgccggcattttcccatctgccttttctctggtttccccaccttgtggcttagagacataaataatggtgtggcggtcctgagtttatataaccatgacctcctacaggcctagatggggtgagatgaggggcccatggggttgcatcggaatccacacaggcagttgcgtgcctgtctgcattggctggattcacatcagggagcaagaaacgggaggcttgagcccagaaagtgtgtcctcatccagccagggtgtctgggcaacagtcatgattagagggtgcggtggggagaagggatgtgtagcctctctgccaagcgtcctttaccctctatggatagatacccagttctcccctcctctccttcaagtgtctgaaacacaggcttcagtgtctgtttttataagagctttattaggatacaattcacataccataaaattcactcttttaacaactgaatggctttagtacatccacagagttgtgcaagcattgccactaattttagaacgttttcaccccccaaaagaaaccgtatacctgttaacatcactcctcactattccctactcccagtccctggcactcactcttctagtctctgtctctataggtttgctttttcaggacatttcatataaaaggaatcgcaaaatacg

SEQ ID NO: 153020 - DNA, 1552 bp, Homo sapiens
  Payload ID: 10102
  Gene Symbol: MESP2
  Gene Name: mesoderm posterior bHLH transcription factor 2
  Uniprot ID: Q0VG99
  ENST ID: ENST00000341735
  CDS Start-End: 1-1194
atggcccagtcgcctcctccgcagagcctcctcggccacgaccactggatcttcgcccagggctggggctgggccggccactgggactccacgtccccggcctcctcctccgattcgtcgggttcgtgcccctgcgacggcgcccgcggactcccgcagccacagcctccgagctgcagctcccgagccgcagaggcagccgcgacgacgcccagacgagcgcgcaccggaccagcgggcggacagcggcagagcgccagcgagcgggagaaactgcgcatgcgcacgctggcccgcgccctgcacgagttgcgccgctttctgcctccctccttggcgccggccggccagagcctgaccaagatcgagacgctgcgcctggccatccgctacatcggccacctatcggccgtgctgggtctcagcgaggagagtctgcagtgccggcgcaggcagcgcggggacgcggggtccccttggggctgcccgctgtgccccgaccgtggccccgcagaggcgcagacgcaggcggaggggcaggggcaagggcaggggcaggggcaggggcaagggcaggggcaaggacaggggcaaggacaggggcaagggcaggggcgcaggccgggcctggtctccgccgtcctcgccgaggcgtcctggggatccccgtccgcctgccccggagcccaagccgcacccgagcgcctggggaggggggtccacgacacggatccctgggcaacacccccttactgccccaagatacagtcgcccccgtattcgtcccaagggacaacctccgacgcgtctctttggacgccaccccaaggctgtccctggacgcagtcgtccccagagccccggaacccaccagtgccctggacggcggccccagcaactttggagctggccgcagtgtaccagggtctctctgtgtctccagagccctgtctgtcgctgggagctccatctctcctgccccacccatcatgccagagactgcagcctcagacccccgggaggtgctggagccacagtgcagaggtggtgcccaactcagaggaccagggaccgggcgccgccttccagctcagtgaagcaagccctccccagagctcaggcctgcggttcagtggctgccctgaactttggcaagaagatctggagggggcccgcctgggcatcttctactaaatggcctcggcttccctctttccatccaggaatcagtcctgtagcttgggtgcctccttatttgttaattagtggcttttcatgttctcctttagccaaggctccctttttccaagtgatgtctttcagggaagcagtgtttgaaatagatagcgggtaccttccctggatggagtcagggcgggggcactgtcctccactgctagacacccccagaatgcctggcgctctgcagagcacagtctgagctgctctaagaaggggtctcctttaccctaaaggcagctgggcagggacaggtgggagaatgggtgtaggaggcaggccccaggctctgcttcttggtgacagttggcca

SEQ ID NO: 153021 - DNA, 859 bp, Homo sapiens
  Payload ID: 10102
  Gene Symbol: MESP2
  Gene Name: mesoderm posterior bHLH transcription factor 2
  ENST ID: ENST00000560219
  CDS Start-End: 140-439
gaggaagtgccgcgtcttggtgggtctggagctggctgacaatgcaggagacaaggtctcgccatgttgcctaggatgttctcgaactcctgaactcaagtaatccaccttggcctcccaaagtgctaggattacaggcatgagccaccacgcccggccaaattgtatgggtctctctgtgtctccagagccctgtctgtcgctgggagctccatctctcctgccccacccatcatgccagagactgcagcctcagacccccgggaggtgctggagccacagtgcagaggtggtgcccaactcagaggaccagggaccgggcgccgccttccagctcagtgaagcaagccctccccagagctcaggcctgcggttcagtggctgccctgaactttggcaagaagatctggagggggcccgcctgggcatcttctactaaatggcctcggcttccctctttccatccaggaatcagtcctgtagcttgggtgcctccttatttgttaattagtggcttttcatgttctcctttagccaaggctccctttttccaagtgatgtctttcagggaagcagtgtttgaaatagatagcgggtaccttccctggatggagtcagggcgggggcactgtcctccactgctagacacccccagaatgcctggcgctctgcagagcacagtctgagctgctctaagaaggggtctcctttaccctaaaggcagctgggcagggacaggtgggagaatgggtgtaggaggcaggccccaggctctgcttcttggtgacagttggccagagccctgtatgctttgatttttttgtacttaaaaagaaaaaacacacacacacaacaaaaa

SEQ ID NO: 153022 - DNA, 2465 bp, Homo sapiens
  Payload ID: 10103
  Gene Symbol: MEST
  Gene Name: mesoderm specific transcript
  Uniprot ID: Q5EB52
  ENST ID: ENST00000223215
  CDS Start-End: 222-1229
caaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 153023 - DNA, 2443 bp, Homo sapiens
  Payload ID: 10103
  Gene Symbol: MEST
  Gene Name: mesoderm specific transcript
  Uniprot ID: Q5EB52
  ENST ID: ENST00000341441
  CDS Start-End: 227-1207
aggtggcgctgacgcctggcagggagaaggcggcagcacatgctgggctcgggggcgatgggcttgtgcgcggacctggcgacgctctagccccgagccgcgtattcgtggccgggtcctccctgggaacagggtgaaggccgagaacctctggcctcaggaagcgcatgcgcaaccggttctccgaaacatggagtcctgtaggcaaggtcttacctgaatcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 153024 - DNA, 2180 bp, Homo sapiens
  Payload ID: 10103
  Gene Symbol: MEST
  Gene Name: mesoderm specific transcript
  Uniprot ID: Q5EB52
  ENST ID: ENST00000378576
  CDS Start-End: 66-944
ccgaaacatggagtcctgtaggcaaggtcttacctgaatcagtgggtctctgcttttcctacaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 153025 - DNA, 2380 bp, Homo sapiens
  Payload ID: 10103
  Gene Symbol: MEST
  Gene Name: mesoderm specific transcript
  Uniprot ID: Q5EB52
  ENST ID: ENST00000393187
  CDS Start-End: 160-1140
gggcgctgctgtggccaggcgtctggcatgctgaccacgtcgcgctgctgtaaaggaaacctgccccgcgcagcggcggtggctggagcgggagaaaccggactttgtgcaactttggccatagtggccatcccatgaatctgtttactagcttggtggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaagtgg

SEQ ID NO: 153026 - DNA, 390 bp, Homo sapiens
  Payload ID: 10103
  Gene Symbol: MEST
  Gene Name: mesoderm specific transcript
  ENST ID: ENST00000399874
  CDS Start-End: 38-390
tggttcagggagggggacagctgaagaaggtgtgaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgt

SEQ ID NO: 153027 - DNA, 555 bp, Homo sapiens
  Payload ID: 10103
  Gene Symbol: MEST
  Gene Name: mesoderm specific transcript
  ENST ID: ENST00000437637
  CDS Start-End: 176-555
attccgcgcccgctctgcctacttgaggagggggtgtcactcctgcccgcaatggaatgttcagaacgcgggacctccttgggttaggatttctagaccccgggatcgtcgtgggattgttcaccttggtttcgcgggttttcaaagtggttcgtctcgcggcgacgccatcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggct

SEQ ID NO: 153028 - DNA, 531 bp, Homo sapiens
  Payload ID: 10103
  Gene Symbol: MEST
  Gene Name: mesoderm specific transcript
  ENST ID: ENST00000458161
  CDS Start-End: 24-531
aaaatcaattctcacacgctgggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggag

SEQ ID NO: 153029 - DNA, 1455 bp, Homo sapiens
  Payload ID: 10103
  Gene Symbol: MEST
  Gene Name: mesoderm specific transcript
  ENST ID: ENST00000437945
  CDS Start-End: 215-1105
cacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccagaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaaga

SEQ ID NO: 153030 - DNA, 794 bp, Homo sapiens
  Payload ID: 10103
  Gene Symbol: MEST
  Gene Name: mesoderm specific transcript
  ENST ID: ENST00000421001
  CDS Start-End: 156-794
gctgctgtggccaggcgtctggcatgctgaccacgtcgcgctgctgtaaaggaaacctgccccgcgcagcggcggtggctggagcgggagaaaccggactttgtgcaactttggccatagtggccatcccatgaatctgtttactagcttggtggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttggg

SEQ ID NO: 153031 - DNA, 2158 bp, Homo sapiens
  Payload ID: 10103
  Gene Symbol: MEST
  Gene Name: mesoderm specific transcript
  Uniprot ID: Q5EB52
  ENST ID: ENST00000416162
  CDS Start-End: 44-922
ccgaaacatggagtcctgtaggcaaggtcttacctgaatcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 153032 - DNA, 882 bp, Homo sapiens
  Payload ID: 10103
  Gene Symbol: MEST
  Gene Name: mesoderm specific transcript
  ENST ID: ENST00000427521
  CDS Start-End: 186-882
gcatgcgcaaccggttctccgaaacatggagtcctgtaggcaaggtcttacctgaatcaggtaagaggcgggcggggaaggagtggagcctccccgtgcaccctcgcagcccgctccaggagtgggactagccctccttgggggtgtggctcgtgtgcgtgggccacaccagtcctaggggcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcttacagtacatcaatcagaggaagaagttcagaaggcgctgggtgggagctcttgcctctgtaactatcccca

SEQ ID NO: 153033 - DNA, 582 bp, Homo sapiens
  Payload ID: 10103
  Gene Symbol: MEST
  Gene Name: mesoderm specific transcript
  ENST ID: ENST00000433159
  CDS Start-End: 101-582
gactgtgcctgtgctgaagccctttcctcctcctagctcccaggcagctagaaaattgcctgtctgaaagaaagtagctgttttccttaggggactgtggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccat

SEQ ID NO: 153034 - DNA, 764 bp, Homo sapiens
  Payload ID: 10103
  Gene Symbol: MEST
  Gene Name: mesoderm specific transcript
  ENST ID: ENST00000463263
  CDS Start-End: 1-522
cttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgt

SEQ ID NO: 153035 - DNA, 606 bp, Homo sapiens
  Payload ID: 10104
  Gene Symbol: MSGN1
  Gene Name: mesogenin 1
  Uniprot ID: A6NI15
  ENST ID: ENST00000281047
  CDS Start-End: 24-605
ccttctgcagctgtctcgcaggcatggacaacctgcgcgagactttcctcagcctcgaggatggcttgggctcctctgacagccctggcctgctgtcttcctgggactggaaggacagggcagggccctttgagctgaatcaggcctccccctctcagagcctttccccggctccatcgctggaatcctattcttcttctccctgtccagctgtggctgggctgccctgtgagcacggcggggccagcagtgggggcagcgaaggctgcagtgtcggtggggccagtggcctggtagaggtggactacaatatgttagctttccagcccacccaccttcagggcggtggtggccccaaggcccagaagggcaccaaagtcaggatgtctgtccagcggaggcggaaagccagcgagagggagaagctcaggatgaggaccttggcagatgccctgcacaccctccggaattacctgccacctgtctacagccagagaggccagcctctcaccaagatccagacactcaagtacaccatcaagtacatcggggaactcacagacctccttaaccgcggcagagagcccagagcccagagcgcgtgag

SEQ ID NO: 153036 - DNA, 2116 bp, Homo sapiens
  Payload ID: 10105
  Gene Symbol: MSLN
  Gene Name: mesothelin
  Uniprot ID: Q13421
  ENST ID: ENST00000382862
  CDS Start-End: 96-1988
ttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggctcctcggcggcccctcccacaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagac

SEQ ID NO: 153037 - DNA, 2162 bp, Homo sapiens
  Payload ID: 10105
  Gene Symbol: MSLN
  Gene Name: mesothelin
  Uniprot ID: Q13421
  ENST ID: ENST00000545450
  CDS Start-End: 169-2037
tgccaggctctccacccccacttcccaattgaggaaaccgaggcagaggaggctcagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgca

SEQ ID NO: 153038 - DNA, 1068 bp, Homo sapiens
  Payload ID: 10105
  Gene Symbol: MSLN
  Gene Name: mesothelin
  ENST ID: ENST00000566269
  CDS Start-End: 1-1003
atcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaaggacctggacctgttctcaccgtcctggcactgctcctagcctccaccctggcctgagggccccactcccttgctggccccagccctgctggggatccccgcctggccaggagcaggcacgg

SEQ ID NO: 153039 - DNA, 2109 bp, Homo sapiens
  Payload ID: 10105
  Gene Symbol: MSLN
  Gene Name: mesothelin
  Uniprot ID: Q13421
  ENST ID: ENST00000563941
  CDS Start-End: 112-1980
ggctgccaggctctccacccccacttcccaattgaggaaaccgaggcagaggaggctcagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagaca

SEQ ID NO: 153040 - DNA, 1084 bp, Homo sapiens
  Payload ID: 10105
  Gene Symbol: MSLN
  Gene Name: mesothelin
  ENST ID: ENST00000563651
  CDS Start-End: 87-1084
gccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctgggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgac

SEQ ID NO: 153041 - DNA, 2418 bp, Homo sapiens
  Payload ID: 10105
  Gene Symbol: MSLN
  Gene Name: mesothelin
  Uniprot ID: Q13421
  ENST ID: ENST00000566549
  CDS Start-End: 418-2286
ccaggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgt

SEQ ID NO: 153042 - DNA, 1195 bp, Homo sapiens
  Payload ID: 10105
  Gene Symbol: MSLN
  Gene Name: mesothelin
  ENST ID: ENST00000561896
  CDS Start-End: 1-1195
gtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaaggtgggcggggcggccaggccagggctgggggcagagctgggggcgtggaggtgggcgctctgagtcacccctctctctgtagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgt

SEQ ID NO: 153043 - DNA, 550 bp, Homo sapiens
  Payload ID: 10105
  Gene Symbol: MSLN
  Gene Name: mesothelin
  ENST ID: ENST00000569566
  CDS Start-End: 41-550
ggcagggccagggtgcggacacaagctgcagacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctgg

SEQ ID NO: 153044 - DNA, 2116 bp, Homo sapiens
  Payload ID: 10105
  Gene Symbol: MSLN
  Gene Name: mesothelin
  Uniprot ID: Q13421
  ENST ID: ENST00000620831
  CDS Start-End: 92-1984
ctctacttcccaggggaggaaaccgaggcacacctgtagccagggagcagggggtcccatcctgagtcactgccctccacagacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggctcctcggcggcccctcccacaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgt

SEQ ID NO: 153045 - DNA, 2109 bp, Homo sapiens
  Payload ID: 10106
  Gene Symbol: MSLNL
  Gene Name: mesothelin-like
  Uniprot ID: Q96KJ4
  ENST ID: ENST00000442466
  CDS Start-End: 1-2109
atggccgcagccgtcaccattcctggcccccgcattggtgccctgcagagctcaggcctcaccctcctgctgtcccttgctgcccactgctctgggccccaggccaaggttctttccccaggagggctggatgccagcggggccaacctgtgggccagtgccaactgctccctgctgcaaggcttctggtgccagccggccagccagctgccccgggaccagctctcagccctaatccagaggctggccttgctgcaggtccccctccaggcctggcagctcagctgcttggccaacctggcgtcacggtgcggcctccaggacgacttcacgctccacccacccaacctgctgctcttctacaacctgagccaggtgcgggaagccgactgccgggccttcatccgccgtgccgcccagggggacgtggagctgctgagccatctacccgaccagagggtcgccctgtggcgtgcggctgtggcctgcctggtgggcgctggcctgcgactcagcgcctccgaccagcaactgctcggggccctggtgtgtgacatggacgcgtccagcatcggtgccgcagacccccacatgctggagaacctgcggcgctgcccccggctgaccgctgcccagcgcattgcccttaactcactgctggccggtgggaagacctcgctcgggccccctggctcctggacactggaggggctacaggccctggggcccctggccacatacatcagccctcacctgtgggcgcaggtgcaggaggccgtgggcctgggcttcttccgcagcgtggtggcttcgtgccaggtgggaaggctcggccagcgcgaggccaggtgcttcgtcaccagcttcctggagtccaagaccaaaccagtgtcctccaggcccaggctcagcacaggcaacatcacggccgccacgctgcgggacgacctcttcctggtgcactacgactgtgcagagcttgagtcctgcctggatggctgcatcctcagaaccaacctggacaccctgttgcagcacctgctgcccactgagtgccagcatgtggtcaaggccaagctcgcacagatctacccacaaggcctcccggaggatcagctgcggctcatcacctcgctggtctacctctactcccgcaccgagatcggccagtggagcatcacctcccaggacacggtcatggctctgctggcctccgacgtggccctggagaaccagacagaggctgtgctgcagaagtttctggagcacaatggcacagtctccggtgccctgctgctggccatcgggggcacccgcctgtgctggatgagtcctcaccagatccagaccatccatccccaggagctccggctggccggggccctggacctctcctcctgcccccagagccggaaggacgtgctctacaccaaggcccatgagaccttcggcagcagcgggaccctagctgcctactaccgcctcatgcgcccctacctcggcggctcccctggtggagcccagcccccctcacccgtccccccaggcggcgccccggtggaggagctgcggcacctggcccacgccaacatctccatggacatcgacaccttcaccagcctgaaccccctcgagctgcagagcctggatgttggcaacgtgactgcgctgctgggccacaacgtgggagaccttcagaaggcccgcagccaccccaccgtcagggcctggctgcgcagcctcaacagctccaccctgggccagctcggcctggacgccagccccaccagccccactggcccagcccacggcaccagggggccccccagcaccacccaccaagtgctccatctggtccacacctcgggcctgcccacgaacgatgcccaggcctccacctcaggcagcctgtgggcccccctggggtacctgcccctggcgatggccctgccttgcagcctcctgtgcctgctgcactgggggacttgcatcctggtttctgtggacagcgttgcctcagggtggctgggttcacaggggtcaggtgcaggaaaaacagaggtgttagattcagctggacgcccacttgggctgacgggccagctctag

SEQ ID NO: 153046 - DNA, 2259 bp, Homo sapiens
  Payload ID: 10106
  Gene Symbol: MSLNL
  Gene Name: mesothelin-like
  ENST ID: ENST00000543963
  CDS Start-End: 1-2259
tcctggacccactgcccttggccccagcaccttcctgccctgggacgtctcagccaggatgaccagtgcacgccgccgcacagacgtgggccccagagtgggtgccctgcagagctcaggcctcaccctcctgctgtcccttgctgcccactgctctgggccccaggccaaggttctttccccaggagggctggatgccagcggggccaacctgtgggccagtgccaactgctccctgctgcaaggcttctggtgccagccggccagccagctgccccgggaccagctctcagccctaatccagaggctggccttgctgcaggtccccctccaggcctggcaggtgagcgggaaggagtctgcttggccaacctggcgtcacggtgcggcctccaggacgacttcacgctccacccacccaacctgctgctcttctacaacctgagccaggtgcgggaagccgactgccgggccttcatccgccgtgccgcccagggggacgtggagctgctgagccatctacccgaccagagggtcgccctgtggcgtgcggctgtggcctgcctggtgggcgctgggtggggatgggcccggtgcattggaggcagcctcccgctgggcgccgacctgctggccctgcagggggtggcccgcctgcgactcagcgcctccgaccagcaactgctcggggccctggtgtgtgacatggacgcgtccagcatcggtgccgcagacccccacatgctggagaacctgcggcgctgcccccggctgaccgctgcccagcgcattgcccttaactcactgctggccggtgggaagacctcgctcgggccccctggctcctggacactggaggggctacaggccctggggcccctggccacatacatcagccctcacctgtgggcgcaggtgcaggaggccgtgggcctgggcttcttccgcagcgtggtggcttcgtgccaggtgggaaggctcggccagcgcgaggccaggtgcttcgtcaccagcttcctggagtccaagaccaaaccagtgtcctccaggcccaggctcagcacaggcaacatcacggccgccacgctgcgggacgacctcttcctggtgcactacgactgtgcagagcttgagtcctgcctggatggctgcatcctcagaaccaacctggacaccctgttgcagcacctgctgcccactgagtgccagcatgtggtcaaggccaagctcgcacagatctacccacaaggcctcccggaggatcagctgcggctcatcacctcgctggtctacctctactcccgcaccgagatcggccagtggagcatcacctcccaggacacggtcatggctctgctggcctccgacgtggccctggagaaccagacagaggctgtgctgcagaagtttctggagcacaatggcacagtctccggtgccctgctgctggccatcgggggcacccgcctgtgctggatgagtcctcaccagatccagaccatccatccccaggagctccggctggccggggccctggacctctcctcctgcccccagagccggaaggacgtgctctacaccaaggcccatgagaccttcggcagcagcgggaccctagctgcctactaccgcctcatgcgcccctacctcggcggctcccctggtggagcccagcccccctcacccgtccccccaggcggcgccccggtggaggagctgcggcacctggcccacgccaacatctccatggacatcgacaccttcaccagcctgaaccccctcgagctgcagagcctggatgttggcaacgtgactgcgctgctgggccacaacgtgggagaccttcagaaggcccgcagccaccccaccgtcagggcctggctgcgcagcctcaacagctccaccctgggccagctcggcctggacgccagccccaccagccccactggcccagcccacggcaccagggggccccccagcaccacccaccaagtgctccatctggtccacacctcgggcctgcccacgaacgatgcccaggcctccacctcaggcagcctgtgggcccccctggggtacctgcccctggcgatggccctgccttgcagcctcctgtgcctgctgcactgggggacttgcatcctggtttctgtggacagcgttgcctcagggtggctgggttcacaggggtcaggtgcaggaaaaacagaggtgttagattcagctggacgcccacttgggctgacgggccagctctag

SEQ ID NO: 153047 - DNA, 4632 bp, Homo sapiens
  Payload ID: 10107
  Gene Symbol: MET
  Gene Name: MET proto-oncogene, receptor tyrosine kinase
  Uniprot ID: P08581
  ENST ID: ENST00000318493
  CDS Start-End: 188-4414
gccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcag

SEQ ID NO: 153048 - DNA, 6635 bp, Homo sapiens
  Payload ID: 10107
  Gene Symbol: MET
  Gene Name: MET proto-oncogene, receptor tyrosine kinase
  Uniprot ID: P08581
  ENST ID: ENST00000397752
  CDS Start-End: 201-4373
aggtgacccggaggccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttgctactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgta

SEQ ID NO: 153049 - DNA, 475 bp, Homo sapiens
  Payload ID: 10107
  Gene Symbol: MET
  Gene Name: MET proto-oncogene, receptor tyrosine kinase
  ENST ID: ENST00000454623
  CDS Start-End: 1-475
gcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggccca

SEQ ID NO: 153050 - DNA, 688 bp, Homo sapiens
  Payload ID: 10107
  Gene Symbol: MET
  Gene Name: MET proto-oncogene, receptor tyrosine kinase
  ENST ID: ENST00000422097
  CDS Start-End: 1-645
gctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagaggtgggattcctgcattcctctcatgatgtaaataaggaagccagtgtaattatgttattctcaggcttaaaataaatcattaaagctcatttatgtgtgggttttggctcatcaactc

SEQ ID NO: 153051 - DNA, 2295 bp, Homo sapiens
  Payload ID: 10107
  Gene Symbol: MET
  Gene Name: MET proto-oncogene, receptor tyrosine kinase
  Uniprot ID: P08581
  ENST ID: ENST00000436117
  CDS Start-End: 1-2295
atgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattaggcatgtcaacatcgctctaattcagagataa

SEQ ID NO: 153052 - DNA, 767 bp, Homo sapiens
  Payload ID: 10107
  Gene Symbol: MET
  Gene Name: MET proto-oncogene, receptor tyrosine kinase
  ENST ID: ENST00000456159
  CDS Start-End: 196-767
gcaggtgacccggaggccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagggtggtgatgaagagtaaatcaaagagtttagcagaatgcttcccatatgataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtg

SEQ ID NO: 153053 - DNA, 6177 bp, Homo sapiens
  Payload ID: 10108
  Gene Symbol: MTDH
  Gene Name: metadherin
  Uniprot ID: Q86UE4
  ENST ID: ENST00000336273
  CDS Start-End: 329-2077
ggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggcccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattttgttttaagagatggcagctggccgggtgcagtggctcacgtctgtaatcccagcactttgggaggccgaggcaggtggatcacgaggtcaggagttcaagaccagcctggccaagagggtgaaaccccatctttactaaaaatacaaaaaaaaaaattagctgggtgtggtggtgggctcctgtaatcccagctactcaggaggctaaggcagagaatcatttgaacccaggagacggagtttgcaaagccaagatcgtgccactgcactccagcctgggcaacagaaggagactccgtctcaaaaaaaaaaaaaagatggcagctatataaatgataaaattaattacattctctttcacatgcatgaggtgcaaactctgtcacaaagtattttaattaccttttaccttgtttcatagatctttatgtgacataaaaacagtttctggcacggtggctcacgcctgtaatcctagcactttgggaggctgaggcaggtggatcacctgaggtcaggagtttgagaccagcctggccaatatggtgaaaccccatctctacaaaatttgcaaaaagtagatgggtgtggtagtgggcgcctgtaatcccagctactcaggaggttgaggcagagaatcgcttgaacccggggggtggaggttgcagtgagctgagatcgcaccactgcactccagcatgaaagagcgagactcaatctcaaaaaaaaaaaagtttctggcacctgaacaggaactggtttccatcatcaactcagaaagcactaaaatctaggtggtgattcagggaggagcaggggaagacagcctcctatggtggcatgaataagatgcttccagaactagtagggaaataactaacctcttcaggctttatcaggcctggaggggaaccttgctcatgttagcaagaaaggtatcctagagaagccactcaaaaggctccctaatccagcctgtctccacatacatactgaaaattcttccctactctgaggcagggtgtagtggtttaggggtttctccagactggaatcctacctatctgtaccgacaattgagcaaacaacagttgagagagtccaaaaaaaaaagtattaaaatgtgattgatgtaatttaccatgtttactttatgcatgcattttattggggaggggaggtcagaataattcacccaaatctagtggtcttatttcataggctaatctggtttatatttgcattaaagatactggagggcaatatttacagagtttagtttttcttaattaaaaacagtcctctattaatatagtgtgaaatatctttcaaaatttagagtttaggtttaagatgtctactagatatctttaagattttcctgtaaactcactgcacaaactggaattactttccaaaagacttagggaatgcaaatatgttactcataagatgcattgagtattgtaaataaaacaaaccatttttgatttgtttaaattgctcgttacagttctcttgtggggagggactttgtcagtcattttgcatcttaagctagactaaactttttgttgttgttttcctaaaaccataggtgcaagctttgccgctgggaagtcatattgaattaagcacttttgaaaatgtcactgtttgtgacacacaatgttctctacagaaaacttcttctatcttatgtcattttagcagtagatgtagctgcctgccaccaggtgcaatatgtcatttgcatcagccttttcagttaaggaaattaaaacttggcatgcattagttcatatgtatgaggttggctgtgtccccaaacagcaattgcttgtacaagatagaagtttgcttctcagctgggcatggtggctcatgcctgtaatccaagctctttgggaggccaacgcgggaggattgtttgagcccaggagtttgaaaccatcctgagcaatagagagacccccatctcgacaaaaaaaaaaaaa

SEQ ID NO: 153054 - DNA, 2184 bp, Homo sapiens
  Payload ID: 10108
  Gene Symbol: MTDH
  Gene Name: metadherin
  ENST ID: ENST00000519934
  CDS Start-End: 31-1611
gccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggcccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaattt

SEQ ID NO: 153055 - DNA, 672 bp, Homo sapiens
  Payload ID: 10108
  Gene Symbol: MTDH
  Gene Name: metadherin
  ENST ID: ENST00000522313
  CDS Start-End: 1-672
cggccgcggcccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaagtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtg

SEQ ID NO: 153056 - DNA, 629 bp, Homo sapiens
  Payload ID: 10108
  Gene Symbol: MTDH
  Gene Name: metadherin
  ENST ID: ENST00000519293
  CDS Start-End: 1-181
ctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaa

SEQ ID NO: 153057 - DNA, 565 bp, Homo sapiens
  Payload ID: 10108
  Gene Symbol: MTDH
  Gene Name: metadherin
  ENST ID: ENST00000521933
  CDS Start-End: 1-565
acaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagct

SEQ ID NO: 153058 - DNA, 4125 bp, Homo sapiens
  Payload ID: 10109
  Gene Symbol: MTF2
  Gene Name: metal response element binding transcription factor 2
  Uniprot ID: Q9Y483
  ENST ID: ENST00000370298
  CDS Start-End: 290-2071
gccattcggcaccggagtcgctccgcgctcccagaatgcaccggcagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttctttttgttttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtattttttaaagagctaa

SEQ ID NO: 153059 - DNA, 1951 bp, Homo sapiens
  Payload ID: 10109
  Gene Symbol: MTF2
  Gene Name: metal response element binding transcription factor 2
  ENST ID: ENST00000370303
  CDS Start-End: 217-1827
gctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaa

SEQ ID NO: 153060 - DNA, 3845 bp, Homo sapiens
  Payload ID: 10109
  Gene Symbol: MTF2
  Gene Name: metal response element binding transcription factor 2
  ENST ID: ENST00000540243
  CDS Start-End: 318-1793
gctgccattcggcaccggagtcgctccgcgctcccagaatgcaccggcagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttctttttgttttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtattttttaaagagct

SEQ ID NO: 153061 - DNA, 4046 bp, Homo sapiens
  Payload ID: 10109
  Gene Symbol: MTF2
  Gene Name: metal response element binding transcription factor 2
  ENST ID: ENST00000545708
  CDS Start-End: 519-1994
gctgccattcggcaccggagtcgctccgcgctcccagaatgcaccggcagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttctttttgttttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtattttttaaagagct

SEQ ID NO: 153062 - DNA, 1502 bp, Homo sapiens
  Payload ID: 10110
  Gene Symbol: MBLAC1
  Gene Name: metallo-beta-lactamase domain containing 1
  Uniprot ID: A4D2B0
  ENST ID: ENST00000398075
  CDS Start-End: 400-1200
agatactcgggacgctgaggcgggaggatcacatgagcccaggaggttgaggctgcagtgaggtatgatcgcgccactgcactcctgcctgggcaactgagcatgaaccctcctcaaagctaatggcgcttcaaaattctgcagtgcaaagaagttgctggggttgcggagcggagaaccgccaggaggctggagcccagccaggcagcctcctcgggcacacggtgaaggcgccggaactacagctacctccgcggcgccgcttcggccgccatatctgggtacacgggaaccgcagaggacaaactctcacccgcgttttcgatttctgcgctttcttcgagtgaggcaagacctagcagaggcccaagcccgtccctccctgccaggagcagcctcatgcggaccgagccgctgtgcggggcatcccctctgctggtgcccggcgacccctactctgtggtggttctgctgcagggctacgcggagccagagggtgtgggcgatgccgtgcgcgccgacggctccgtgaccctggtcctaccccagacccggggcccggcctccagccaccgagagtccccgcgcgggagtggcggcgcagaggccgccctggaggaggcggcccgtggccccatcctggtggacaccgggggcccctgggctcgggaggcgctgctgggggcgctggcggggcagggcgtggccccgggagacgtgacgctagtggtggggacccacgggcactcggatcacatcgggaacttggggctgttcccaggcgcggctctgctggtctcgcacgacttctgccttcccggaggccgctacctgccccacgggctgggtgaggggcagcccctgcgcctgggcccggggctcgaggtgtgggccacgccgggccacgggggccagcgcgacgtgagcgtggtggtggccggcacggctctgggcaccgtggtggtggcgggagatgtgtttgagcgagatggggacgaggattcgtggcaggcactgagtgaagaccccgcagcccaggagcggagccggaagagggtcctggtcgttgccgacgtggtcgtacctggtcacgggcccccctttcgagtgttaagggaagcctcgcagcccgagacggagggtggagggaacagccagcaggagccggtggtcggagacgaggagcccgccctgcactaatcagcctcgagagggactgcactcttgtcagggaagccctaacagcgaagagctgctggagacagagtcagagcagtcaagggtgggagcttccagcccttccaggaggccagttttctagtgaagacagagtgcacctgacactgccatcacatcgtcagtatcactgcctgtctctgccaccaaactaagatcaaaggaggggctcagctccctgtgcattctccctgggcctcagtaaaatgggagaaggttcgtgggaggggcctccaaaataaaaatggaaactgcattgaaaatca

SEQ ID NO: 153063 - DNA, 718 bp, Homo sapiens
  Payload ID: 10110
  Gene Symbol: MBLAC1
  Gene Name: metallo-beta-lactamase domain containing 1
  ENST ID: ENST00000421390
  CDS Start-End: 378-718
ggcaactgagcatgaaccctcctcaaagctaatggcgcttcaaaattctgcagtgcaaagaagttgctggggttgcggagcggagaaccgccaggaggctggagcccagccaggcagcctcctcgggcacacggtgaaggcgccggaactacagctacctccgcggcgccgcttcggccgccatatctgggtacacgggaaccgcagaggacaaactctcacccgcgttttcgatttctgcgctttcttcgagtgaggcaagacctagcagaggcccaaggtagagcgcggctaggattcgatggagggaaacataaaggatagcctttggagggtgacgggcaaggaccccgtccctccctgccaggagcagcctcatgcggaccgagccgctgtgcggggcatcccctctgctggtgcccggcgacccctactctgtggtggttctgctgcagggctacgcggagccagagggtgtgggcgatgccgtgcgcgccgacggctccgtgaccctggtcctaccccagacccggggcccggcctccagccaccgagagtccccgcgcgggagtggcggcgcagaggccgccctggaggaggcggcccgtggccccatcctggtggacaccgggggcccctgggctcgggaggcgctgctgggggcgctggcggggcagggcgtggccccgggagacgtgacgctagtggtggggaccca

SEQ ID NO: 153064 - DNA, 4280 bp, Homo sapiens
  Payload ID: 10111
  Gene Symbol: MBLAC2
  Gene Name: metallo-beta-lactamase domain containing 2
  Uniprot ID: Q68D91
  ENST ID: ENST00000316610
  CDS Start-End: 477-1316
caacccgcgaggccccacactttctgcgccagctgggagtgcgcgccctgcagagccagtgggtgggcggttctagctcttcccaccctcactgcgggcctctgctgtcacacgcccggggtggcgaaacggtcgccacctgagtctccattctgctgcagtggcccctgcgttaaagctctctcgtggtgcggctgccgaggctgcggtagctcctgcgcccccgtgctggtggcgcagcctctgcttgctgccgacctggcggaagggtgcgggagcgcacgctacgggcagcgtcggtctgcgtccttcctcctcctattccgacccccgcatcccacgcccccgcctcgctctacgcctcctccctggctgcaggcagaccgcttcacacagccgcagtgccctgtgtgtggacagcctgtgggagactcgcacgcccacactcaccccgcctggctgcacccctgcccagcatgtcggcgctcgagtggtacgcccacaagtctctaggcgatggtatcttctggattcaagaacgtttctacgagtcgggcaaccgtgccaacatctggctggtgcgcggctccgagcaggacgtggtgatcgatacaggcctggggctgcgcagcctcccggagtacctgtactcctccggcctcttgcaggaccgagaggccaaagaggacgcggcgcgccggccactgcttgccgtggccacccacgtgcacttcgaccactccggcggcctctaccagttcgaccgcgtggcagtgcaccacgccgaggccgaggcgctggctcgcggggacaactttgagaccgtgacctggctttccgatagcgaggtggtgcggacgcccagccccggctggagggccagacagttccgggtacaggcggtgcagcccaccctcatcctgcaggatggggatgtgatcaaccttggtgacagacagctcactgttatgcacatgccaggtcactccaggggcagtatttgcttacatgacaaagaccgaaagattctcttcagtggagacgtcgtgtatgatggatcactgattgactggctcccatacagcaggataagtgactatgttggaacttgtgaacgtctaatagaattagtggacagaggtctggtagagaaggtgcttcctgggcacttcaatacctttggtgctgaaaggctttttcgattggcttctaactatatttcaaaagctgggatatgtcacaaagtttctacttttgccatgcgatctcttgcaagtttagctctacgtgtaacaaattctaggacctcgccctagtatctatactgataatatattttgattaattatatacattaattcattctgtgctatttaactgattaatagtgagcatttcatgaagtgcttttataccactattatatatcagagaaagattgagaatgaataagccaaaaagaaaattgttagtttaaattgttttctttcttccaagaaagaagccacttaaataagcttatactttgccaaagctgtcatcttgtaatatatgctctagaaatgacataaaggtttatggggaagcaaagagagattttgtggcaagagaactgcccttgcctctgtttttcttgttttattcccttgatgacctagggaaaaaaaggcatgtagagtattatgtttatactttaaacttgatatttttagtgtattatttaaagataaaggttcttgggtttaaaatacattagaacttaatgcagacatataaagtaacattgagaatgacaactaaaacattccattgttatggtcctgaattttttatgcttcatttcatgtatttattctttgtataattatagcatacatgttatgtaatataacttatgaaaagtacagtgaattttgctttattgcaaagctttaaatataaatttcagagtgcttcagtaaaaagctactatatattgttgtttgttattgtgtaggtaatattttcaattatgaaagtgaaatgcaaatgtctgttatctaactacaaattgtcagatttcttaaaaggacactgtcaggcaaatttgaaaatatacacattgagaataattttttattattatatcctattttaatattaacagctattatgaacaaaatttttcctgttaaatagcgacttcagtattgtgttatgttttacagcgttaaaacaactatgaagatctgcagctattcttttacttaacatgcatatgtactacagagggatttttaaattaattgcaaaatgtgcattagctattgacttagagtgaattgccttttgtatcctgattcacaacacctattcctgttcagtattctttgtcttgaatagagaagtctatgttcgtaaagtcatataaaaggttataccactatttagtaaaaagttttagtttggtgctgttaataataatttgctaaaaggccttttagaatatttcataaagggttttaaacagttttttcccactgcctttttattattgacatatctaaaaccaaactgaaatcgctttggaaatcagattttttaatgttaggaagatccagcaattttggtttctgaaaaattacaaaacttttctaccctacagatgcccaggttctttagttttttattcattcaactcacacacacataaacatatacatacacaaacacaatcccacatgcaaacacacacagccacatatatacatgtgtagcacagcgctaaacactgtggaggctaaaaaaagtcaaagacaacattataactaaaagtcgaaagcacacaaaatataaataatagtgtatgcaagttaatgtacattatacatgcgtgtaagggacataaatggaggggtgtgaactttggttaggcaaagtttactggaggaggggtttttgagtcaaatttggaaggatgaacttgttagatagtcagagttggaaacaaaacaatccaagaatagggatataagcattgctagtctagaatagtctattccttgtgaaaatataaatttaattttcaggaatccagtatattccaaacatcacatatttagcatgagaaaaattgatttgtgattgtgtatatgagtcattgttaatgggagacaagctgaactgccacatgccaccaaatgaacctttacttcaatcaaaaaggagggtatgattggttcaattatattaacagaatatcatgggcatttctctatgatggtcattcaaggtagtaggtctctttcaactgagtgcaacattgagaataatgatttggttcagggcaactacaaataatcacttactaagccttaaataaagccattatttttatatcaatagcacaaaggaaaaccaaaagtccttaaccactgaccatttttatcatattttaggcctttttttaaaaaatcagggtatagtaggcactaagttttattaggaaatatttaaacctgctgaaggatttatttataaaaagtgcaatttttcaaaacacattattattttttaatttcccaattttttcagtttttcaaattgtaccacaacatagaactgtgatattttgctattacttcaatgtgaataaataaggtaaagtatatcatttattgagtgcccatgctgtacatttaaaatatgcattatttaatttaatcttactcccagcaccaaaaggtaattgaccagcctcaacacaattttggacaaagctagtaactgaacacaggtctgtctgccccacacttctctttctcttgtaactgcacaatagcagaaaattggcaagatgtatttttactttccaagatgccgtgtgtgccaagaataaatgaaatgatgttaaagcataataataacatatctttaaaaagcttttcaaaatatattttcaccctgacagtgacccttgtaacttaaatgatttttggaaatattagtatgtaagtataattcaaagttgtcaaaatgtaagacatttagaagtaatttttattatttatattgttaatacttaatcactggaaattcattttccttactcgatgttttctttcaactgagaagcctaaaacaaacaaaaaccttgtgtgttatcctgatatagttgactaaatgtatttgttcttatatggatagtaatatgaatgtgacatgcaccaattgtcctattataattttcagataagtgtaactaagcacttgtgtaataaatattagtcattttatttcaa

SEQ ID NO: 153065 - DNA, 1936 bp, Homo sapiens
  Payload ID: 10111
  Gene Symbol: MBLAC2
  Gene Name: metallo-beta-lactamase domain containing 2
  Uniprot ID: Q68D91
  ENST ID: ENST00000514906
  CDS Start-End: 87-686
acacagccgcagtgccctgtgtgtggacagcctgtgggagactcgcacgcccacactcaccccgcctggctgcacccctgcccagcatgtcggcgctcgagtggtacgcccacaagtctctaggcgatggtatcttctggattcaagaacgtttctacgagtcgggcaaccgtgccaacatctggctggtgcgcggctccgagcaggacgtggtgatcgatacaggcctggggctgcgcagcctcccggagtacctgtactcctccggcctcttgcaggaccgagaggccaaagaggacgcggcgcgccggccactgcttgccgtggccacccacgtgcacttcgaccactccggcggcctctaccagttcgaccgcgtggcagtgcaccacgccgaggccgaggcgctggctcgcggggacaactttgagaccgtgacctggctttccgatagcgaggtggtgcggacgcccagccccggctggagggccagacagttccgggtacaggcggtgcagcccaccctcatcctgcaggatggtaatgggcccccgcgggcgcgcgctctcgttaagggagggtattgggaagagactgtccgagtgccgcatgttgcagacttgcgtggccataaaggggattattttggcacctcgcagagccacttctgtttcacccttccctgagtaaaaacccacttgaccagagtcaaggccatcacagccttccctgccagagaccagctctggcatcgtgtagagattctgagtactcctttgaaagccggcaccaccccctccctagccactttcctgcatcggctgtagcagtaacactacaaagacttgtgactgactagggatttctcattctttccctaagcacctgcccgacatttccaggagctttcgtagtgagcagacttttaaggaatgacccctcacggagagtgcatgtcatgatctgtgcttttgagaattgcagacttcatcagcttggtccccaccgggtatgggcagttcccacctgtagccttagagagtcatcagaccagtgattccaatccgctaatgcgattggaaacctttcagataggtttctgttcttgatgttgcctcacgattgcaaaagcttaatagtaatcataaacgtagaatatgtctgagtcttactttatgacagatatttggtccggttgaaagcaaagcctgagaaagatcaataaggaagtaattttcggtagaggtaaattatgtggactaatgcataggtagccatggtcctctttggctctgtgaaagacaagtatggaattcagagagaaattcatggaatgaaaataaatagggcctcagcccattctccctacgtagggacttaaataattgagctaattcgccacatcagcaatatttggtatattagttttctattttctttttaaaatacttttgatttcattttatcttcacaacacatttaaagtgaggccactgaccccccagttaaatggcttgcctgagccagatcatgataaaagctaggatatgaatctaggcacaatagatcaaggcatgcagaacatacataaatcctgcctcataaatatatgatgattttgagtagaatgtgaaaggccccttctttcctttagcgtgagatcattttaattaccaatgtggtatattaaaacgtgcctctatatggtagaaaaattcagttgctgcagtataatgaagctcactttatgaccaaacaatatggcaaataatgaaatattttacaaaaatcagtttatctcacagatgacatcttcatttgagatattttaaaaattgcaatattgtactgcttatcggtgctaaaaaaaaaattgcaagattctgtacctcacacccaccgaacaagtcttcattaaagttttaaatctaaattt

SEQ ID NO: 153066 - DNA, 1636 bp, Homo sapiens
  Payload ID: 10112
  Gene Symbol: MPPE1
  Gene Name: metallophosphoesterase 1
  Uniprot ID: Q53F39
  ENST ID: ENST00000309976
  CDS Start-End: 243-1244
aggaagttggctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttgtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctctt

SEQ ID NO: 153067 - DNA, 1910 bp, Homo sapiens
  Payload ID: 10112
  Gene Symbol: MPPE1
  Gene Name: metallophosphoesterase 1
  ENST ID: ENST00000317251
  CDS Start-End: 454-1185
accgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattatagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagagatggagttttgctgtgttgcccatgctggttttgaactcctggcctcaagtgatcctccctccttggcctcccaaagcattgaaattacagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggcacgtggctccagccggtgtggacctgggcctctgctgcccacgtctgcccctgtcctcctgcagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctctt

SEQ ID NO: 153068 - DNA, 2324 bp, Homo sapiens
  Payload ID: 10112
  Gene Symbol: MPPE1
  Gene Name: metallophosphoesterase 1
  Uniprot ID: Q53F39
  ENST ID: ENST00000317235
  CDS Start-End: 349-1350
ggaagttggctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaa

SEQ ID NO: 153069 - DNA, 1831 bp, Homo sapiens
  Payload ID: 10112
  Gene Symbol: MPPE1
  Gene Name: metallophosphoesterase 1
  ENST ID: ENST00000344987
  CDS Start-End: 330-1454
gccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattg

SEQ ID NO: 153070 - DNA, 2427 bp, Homo sapiens
  Payload ID: 10112
  Gene Symbol: MPPE1
  Gene Name: metallophosphoesterase 1
  Uniprot ID: Q53F39
  ENST ID: ENST00000496196
  CDS Start-End: 317-1339
gcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggcacgtggctccagccggtgtggacctgggcctctgctgcccacgtctgcccctgtcctcctgcagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggggccagttttgacagggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaa

SEQ ID NO: 153071 - DNA, 582 bp, Homo sapiens
  Payload ID: 10112
  Gene Symbol: MPPE1
  Gene Name: metallophosphoesterase 1
  ENST ID: ENST00000592306
  CDS Start-End: 1-246
ctgacttgtacccagcaggcacgtggctccagccggtgtggacctgggcctctgctgcccacgtctgcccctgtcctcctgcagcattatcctctgtatcggagaagtgatgctaactgttctggggaagacgctgctcctgcagaggaaagggacatcccatttaaggagaactatgacgtgctttcacgggaggcatcacaaaaggaaagaagcgatggccagcggccgtctgctgagcggtgagagcctggttgaggatgagctaacagcctgctttgctgtcttctcggccactgtcagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggtagcatcacgcccacagactacaccctctccaagtgctacctcccacgtgaggatgtggttttgatcatctactgtggagtggtgggcttccttgtggtcctcacactcactcactttgggcttctagcctcacct

SEQ ID NO: 153072 - DNA, 885 bp, Homo sapiens
  Payload ID: 10112
  Gene Symbol: MPPE1
  Gene Name: metallophosphoesterase 1
  ENST ID: ENST00000589267
  CDS Start-End: 461-885
gcgctaccgcggaaacaggaagttggctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattatagaatattaatgaaactttatcatcttggtgagaaaagcattctaatagctttattctgacatacggaggtatggagagcttgaaggagtcagagaggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaat

SEQ ID NO: 153073 - DNA, 4236 bp, Homo sapiens
  Payload ID: 10112
  Gene Symbol: MPPE1
  Gene Name: metallophosphoesterase 1
  Uniprot ID: Q53F39
  ENST ID: ENST00000588072
  CDS Start-End: 1223-2413
aagcaagtgcataataaatattatagttatcctgattgtctcctttattcatcacacacttcctaagcacatctctggagggcactttccaaggctccgggggaggagaggaaagaggcgcagccaggcctggtgggtcccggaggggcagcgcggcgcgggaggggaacggggaggcacggcctggctgccaccgcgcgcggaacccgggagcggctccggggctgtcagctgcccgcctggctcctccaaggcctggagctcggacgcgggctctgggggcttctggggcgcggaagcgggctcgcggggagcagtggccgcccccggccgccgcggtggctgtgctcagaagccggccctggcgtcaggaggccgggcgcgcggcgcggggcgcgagttcccctgcccgcctgtgcgccccgcaacgggcctttcctgggccctaacgacagctcgcccgtgcttcgccctcgcagctctcctgtgtccccaaaatgcctttcccgcgtcccccgcccttcagcggtgactgcccaggggactctgtaacgcgacactcagactgccgagcctgccaggcacttcgcggagggcgctaggggccgggacgcggccgccgagcgtaggttccggcctttactccgagttgcgcacggagccccagctgcggttgtccgctctggggatcacaggccgcggagacccgggagccacccgccgggccccttcagacgacccgcttccgcaaaccggccgtgggactccggcgccgggcggacgaagcggctccgggaagactcggtcttccccgcccgcctgaggtcgccggggcggggcttcagtgacaggcccgcgcgctaccgcggaaacaggaagttggctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggcacgtggctccagccggtgtggacctgggcctctgctgcccacgtctgcccctgtcctcctgcagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtgaagtggttctcaaattcctatgtactgtaaagctgtacccttaaaagtacagatgtggccgggcacagtggctcacacctgtaatcccagcactttgggaggctgaggcgggtggatcacttgaggtcaggagttcaagaccagcctggccaacatggtgaaacctcgtctccgctagaaatacaaaaattagccaagcatggtagcaagtgcctataataccagctgaggctgaggcaggagaatcccttgagcccgggaggcggaggttgcagtgagccaagatcatgccactgcactccagcctgggcaacagagtgagactccgtctcaaaaaatatatttaaaaaaaaaaaagtacagatgtgatgtgcagaacatattgttttcgtagatttttatacttgatcaattaatggaatcagatttttagataagtgtaattttctctataggagaccacgttgctacatctgttaatgcctgtcagtgatcaaaagaaacttaaaaagtggaatgggatatggcttttggtacctgaaaataaatgctttaataattgtaagccagataaaagttattctttttgttttttttcttaacagtctggctgttgtttgaattaaactcttaaacaggatgtttagttagagggtaattgttgagtaatgatgcatacaacagcatacttccctttcttgctgggggtgcagcttttcagttttcttgttttactttgacagtgcaaggggaactgaaaataatttccattgtattatttatcttagttcagctgagggctttatgagacagtggatggggaggcagtaagacggtgatgagataaaatgtgtgtgttgcactgactgtctataaagttatcctttcttcatgaaaaagtagcatttaaatctggatgagtttataaaggattacaaaatgctgatttatagagtaaactttaaaatattaaagactaaagactaaaagaagagtaataatgaagtaatgtaggctgtcacttctctagatttgtattgttgaaaatttaactttggacatctttatagattattattttagacctacaaaaactaccctcaactctgtggctacagctagaatatgaagcatcattgctacaccagttcttactttctagatattgttggtgtgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggttttttttttttttttttttggcctgagtctcactttgatgtccaggctggagtgcgatggcacgacctcggctcactgcaat

SEQ ID NO: 153074 - DNA, 622 bp, Homo sapiens
  Payload ID: 10112
  Gene Symbol: MPPE1
  Gene Name: metallophosphoesterase 1
  ENST ID: ENST00000587724
  CDS Start-End: 1-486
ggaaaccatgacattggcttccattatgactttgtgatggtcaacagcgtggcgctgaacggggatggctgtggcatctgctctgaaacagaagcagagctcattgaagtttctcacagactgaactgctcccgagagcaggcacgtggctccagccggtgtggacctgggcctctgctgcccacgtctgcccctgtcctcctgcagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggaacagatgcttagttgagcatcaaggggcaggaagacacctttccctccttgttcctcgctgaccgatgaccctggaactccacggtgcctctctgaatctctgttatggatcccccactatatttgatgggaacccagtgagccaggg

SEQ ID NO: 153075 - DNA, 602 bp, Homo sapiens
  Payload ID: 10112
  Gene Symbol: MPPE1
  Gene Name: metallophosphoesterase 1
  ENST ID: ENST00000592331
  CDS Start-End: 86-602
ttttggctgacacccatttgcttggggaattcctaggccactggctggacaaattacgaagagatggagttttgctgtgttgcccatgctggttttgaactcctggcctcaagtgatcctccctccttggcctcccaaagcattgaaattacagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagagcaggcacgtggctccagccggtgtggacctgggcctctgctgcccacgtctgcccctgtcc

SEQ ID NO: 153076 - DNA, 379 bp, Homo sapiens
  Payload ID: 10112
  Gene Symbol: MPPE1
  Gene Name: metallophosphoesterase 1
  ENST ID: ENST00000593001
  CDS Start-End: 301-379
tcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactca

SEQ ID NO: 153077 - DNA, 1152 bp, Homo sapiens
  Payload ID: 10112
  Gene Symbol: MPPE1
  Gene Name: metallophosphoesterase 1
  ENST ID: ENST00000588191
  CDS Start-End: 659-1152
gaagttggctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattatagaagcactgaggtggacactgcgggttgtgaggttcaggaggggtaagtggctggcacaaggtcacagagcagcgctgccatttggctactttccaattcagcatagctgccctctctgctggtggtattcacagcatgcaagataaaatactcaccaaggaacaagtggctaactcctcacagagctctcacggtttcctctttcctgacaaaaagaatattaatgaaactttatcatcttggtgagaaaagcattctaatagctttattctgacatacggaggtatggagagcttgaaggagtcagagaggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatga

SEQ ID NO: 153078 - DNA, 567 bp, Homo sapiens
  Payload ID: 10112
  Gene Symbol: MPPE1
  Gene Name: metallophosphoesterase 1
  ENST ID: ENST00000589859
  CDS Start-End: 359-567
ttttgcgcctcttagtcataactgctcaaacaaggctcactctgatgaagagaagggggtgtagaagaggaattatcaaggtgtcattctggtatttcatcttgggaaaccagaaacctaccaaacagcaagggtttgcatactggaagactcctcagcctgccccagaagaatattaatgaaactttatcatcttggtgagaaaagcattctaatagctttattctgacatacggaggtatggagagcttgaaggagtcagagaggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgct

SEQ ID NO: 153079 - DNA, 1099 bp, Homo sapiens
  Payload ID: 10112
  Gene Symbol: MPPE1
  Gene Name: metallophosphoesterase 1
  ENST ID: ENST00000588186
  CDS Start-End: 566-1099
aggaagttggctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattatagaagcactgaggtggacactgcgggttgtgaggttcaggaggggtaagtggctggcacaaggtcacagagcagcgctgccatttggctactttccaattcagcatagctgccctctctgctggtggtattcacagcatgcaagataaaatactcaccaaggaacaagtggctaactcctcacagagctctcacggtttcctctttcctgacaaaaaggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttc

SEQ ID NO: 153080 - DNA, 698 bp, Homo sapiens
  Payload ID: 10112
  Gene Symbol: MPPE1
  Gene Name: metallophosphoesterase 1
  ENST ID: ENST00000588103
  CDS Start-End: 423-698
cgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattatagaggctctccagcagagaacccaggcccttcaccatactggtgcatggttcctgccacttgtgcagtccattccgaagtttcttacagatgaggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaatta

SEQ ID NO: 153081 - DNA, 564 bp, Homo sapiens
  Payload ID: 10112
  Gene Symbol: MPPE1
  Gene Name: metallophosphoesterase 1
  ENST ID: ENST00000586844
  CDS Start-End: 359-564
gcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattatagaagcactgaggtggacactgcgggttgtgaggttcaggaggggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgt

SEQ ID NO: 153082 - DNA, 1089 bp, Homo sapiens
  Payload ID: 10112
  Gene Symbol: MPPE1
  Gene Name: metallophosphoesterase 1
  ENST ID: ENST00000592977
  CDS Start-End: 166-1089
gaaagggctcccgcaccgcccggtgctccccatctgcctggcgttgtgcgcagagctggaaagcatggctgttgtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagaggcacgtggctccagccggtgtggacctgggcctctgctgcccacgtctgcccctgtcctcctgcagcattatcctctgtatcggagaagtgatgctaactgttctggggaagacgctgctcctgcagaggaaagggacatcccatttaaggagaactatgacgtgctttcacgggaggcatcacaaaagctgctgtggtggctccagccgcgcctggttctcagtggccacacgcacagcgcctgc

SEQ ID NO: 153083 - DNA, 818 bp, Homo sapiens
  Payload ID: 10112
  Gene Symbol: MPPE1
  Gene Name: metallophosphoesterase 1
  ENST ID: ENST00000590501
  CDS Start-End: 537-818
gggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattatagaagcactgaggtggacactgcgggttgtgaggttcaggagggaggctctccagcagagaacccaggcccttcaccatactggtgcatggttcctgccacttgtgcagtccattccgaagtttcttacagatgagaatattaatgaaactttatcatcttggtgagaaaagcattctaatagctttattctgacatacggaggtatggagagcttgaaggagtcagagaggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagg

SEQ ID NO: 153084 - DNA, 582 bp, Homo sapiens
  Payload ID: 10113
  Gene Symbol: MPPED1
  Gene Name: metallophosphoesterase domain containing 1
  ENST ID: ENST00000334209
  CDS Start-End: 225-582
cacttgcagcctcggacgcgcggcgaggcggccgccgccggaggagcccccgcccctgcgcgcctccctcccgggagcccctgcctccctcggtgcgcgctgctgctcgcagccgccgcggccgccgaagaggagcccggggccagtctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttca

SEQ ID NO: 153085 - DNA, 3657 bp, Homo sapiens
  Payload ID: 10113
  Gene Symbol: MPPED1
  Gene Name: metallophosphoesterase domain containing 1
  Uniprot ID: O15442
  ENST ID: ENST00000417669
  CDS Start-End: 445-1425
agcaaggcagggcctctttacactgggtgtcgcgccgtctgagttcctgacttgtttacccatcccgttggggctccggccgctgcaggctacctgctgtgcccgggattggggacctgtgactcccgagtggaagagatggtggcccaggaggaggaccccgacctattcagactgggagctggggtcagagtgtctccgtctccggagggggaccttccagaccccgggcgggaggggcccacagcagggtgccccggcggccccaggagggggtccgggcctcgggcgaaggctgcggcgccccggaaggagccgcgcacgcccctgcacgcggtgcccgctgcggaggccacggatccggagtctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttcactgagctggggctcccgagcgaggtgaagaagttcaacgagtggctgggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagccctggttctacggctggggcttcaacctcccgcgaggccaagccctgctggagaaatggaacctcattcccgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactgttccttccatgctgagttgcctggacgacccatctggctgcggggactggcctagcaggcaggtcagggccttggaacgactctttagccttctgtcacctggagttgggaccctgcgcatccccatcaggggttctgtgctcatttactttttctgcgtgtacatcctgcgtgtacctcgttaaaggacctactaagctcatggccctgtcatgtttgggaaatgactaaatcttcattcttctcccttggacgccctcctggtttgggaagctgctgctcttgaatgggttttggaagttacacaaaatctccctctaaccacgggtctgtgtggcggcatgcccctgggttggggtgggtgggaggattcgtgagctgcacacagacagtccctttctctcctcccaagtgagggaggagacaggcccaaggcggaggccctccgagggagcatttagggacatctcaggaattcagaccgcacctggccaggcccacagctgtttgcctggcattgttcccccctttttcttcccataggcatttttgtttacttgaacaatgacctgagtgtcctaggcattcactcggagcctggatgatgggggctggttctacagaatgagccactggcattcgtgcccaggaccagtgagagcgttcccagtcatggggggatgacccttggtcccacggggaacacactgctctgtagaatgcggtagcctggatggagggtctgcaggcttaggctgcagcaggcctgccatgggtgtgaacccatgtccaggcacgcaccgacacacatgcacgcacgcacccctcttaattgaaccaagtgggtcctgtgtttctcttttctgccccgtagtgaggttctgttccttggtgcggcttcccttgcaccgttaggattctgtctggcatgcctgcagccgaggaagcccaggaccagccggccctgtgaattggagggtggcacagggaccgagcgggccccaggctccagcagccccaccttggacagcttctttttcttctttgaattaggactggagggggtggggccagggcggtggtgggaaccggtagggcctagatgaggggcaggcagtcaggcagaaatgggcaagttcagggtcagattctgtcgttatttaatattttgttcatcatggactttttctgcatttattttgatttttaacgttgcattaaagtagtattatttgtcctgattggtgactttttttgcacccctttccgttgtacatctgagagaagggtgtcactccctcacccaggtcccagccctgggaaccagcctaccgtgagcccttttgcagatatagactcatttcatcctcagatggtccttcaaggtaggtactttagtcccattttagagatgagacgattgaggccagaggggtgtggtaacttgcctgggggctcacagcacaaaaggagccgaggcaggatctgacccttgttctctggcctcactgccctcactttgccatgacccgaagttatgtccctacaaagcaatgcatggtccaaggctctttttattgtatttttatttttaagggtcctgttcaaaactggtgtgagctctgaggagtcctgaaccctgggtgcagcatcctagcatcctgggagtccttttctgcccacactgagctgggctcctcgaggggtggggctgctgtccctggaagcctggcagcagcactgtatcgggttggctgaagctgagcgccgtggggtgcagggctccaggaatcccgtttggctgaaggggttcctgtagccagggatgtttatgaggtctctctgatgccccaggcgcaggacatgtgtgcgggtggagaaaagcaggccctttcagtgccagctccactcaatttctatgtggaccaagaacgataaacttaaaaaaatttttttcctaaggtatcttcagaatatggtgtatttttatgtggaaaagaaaagttatgaaggcagctgttactttaagagaaaattcattaaaagtcctcgaggtatgaagatgacggcgtgcttctcaatcattttggcataacttgattgtggctgtaatttttttttttttttttgtcaagcatgtcagacaataaagtctttgtaaaaagagaa

SEQ ID NO: 153086 - DNA, 2507 bp, Homo sapiens
  Payload ID: 10113
  Gene Symbol: MPPED1
  Gene Name: metallophosphoesterase domain containing 1
  Uniprot ID: O15442
  ENST ID: ENST00000443721
  CDS Start-End: 224-1204
acttgcagcctcggacgcgcggcgaggcggccgccgccggaggagcccccgcccctgcgcgcctccctcccgggagcccctgcctccctcggtgcgcgctgctgctcgcagccgccgcggccgccgaagaggagcccggggccagtctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttcactgagctggggctcccgagcgaggtgaagaagttcaacgagtggctgggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagccctggttctacggctggggcttcaacctcccgcgaggccaagccctgctggagaaatggaacctcattcccgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactgttccttccatgctgagttgcctggacgacccatctggctgcggggactggcctagcaggcaggtcagggccttggaacgactctttagccttctgtcacctggagttgggaccctgcgcatccccatcaggggttctgtgctcatttactttttctgcgtgtacatcctgcgtgtacctcgttaaaggacctactaagctcatggccctgtcatgtttgggaaatgactaaatcttcattcttctcccttggacgccctcctggtttgggaagctgctgctcttgaatgggttttggaagttacacaaaatctccctctaaccacgggtctgtgtggcggcatgcccctgggttggggtgggtgggaggattcgtgagctgcacacagacagtccctttctctcctcccaagtgagggaggagacaggcccaaggcggaggccctccgagggagcatttagggacatctcaggaattcagaccgcacctggccaggcccacagctgtttgcctggcattgttcccccctttttcttcccataggcatttttgtttacttgaacaatgacctgagtgtcctaggcattcactcggagcctggatgatgggggctggttctacagaatgagccactggcattcgtgcccaggaccagtgagagcgttcccagtcatggggggatgacccttggtcccacggggaacacactgctctgtagaatgcggtagcctggatggagggtctgcaggcttaggctgcagcaggcctgccatgggtgtgaacccatgtccaggcacgcaccgacacacatgcacgcacgcacccctcttaattgaaccaagtgggtcctgtgtttctcttttctgccccgtagtgaggttctgttccttggtgcggcttcccttgcaccgttaggattctgtctggcatgcctgcagccgaggaagcccaggaccagccggccctgtgaattggagggtggcacagggaccgagcgggccccaggctccagcagccccaccttggacagcttctttttcttctttgaattaggactggagggggtggggccagggcggtggtgggaaccggtagggcctagatgaggggcaggcagtcaggcagaaatgggcaagttcagggtcagattctgtcgttatttaatattttgttcatcatggactttttctgcatttattttgatttttaacgttgcattaaagtagtattatttgtcctg

SEQ ID NO: 153087 - DNA, 728 bp, Homo sapiens
  Payload ID: 10113
  Gene Symbol: MPPED1
  Gene Name: metallophosphoesterase domain containing 1
  ENST ID: ENST00000447567
  CDS Start-End: 505-728
aaattgtatttgaatcctgagcaaccacagccctctagcctcttcccctccctagccatatctgaacagcttcccatttcaactccatagatacgtgactctccaagtgctttattttgaaaactaggacgtagcactttgcagaagaaaaatcagtccacttgctattatttatgtgatcgctgatctgctagatggatatagaaagcaccaagaattataataatttatggagtagagcactggtttacaaacatatttctctgcccgagctttgtgtgtttctttgcgtctcggggctcgttctgtgcaatgggaatggagaatattcagaatttgaagacaagcccggcgagccgactgcattcatagctaaaattaaaggaataagtgagcagctatttgtggcagacaggacatgatccatctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagat

SEQ ID NO: 153088 - DNA, 2405 bp, Homo sapiens
  Payload ID: 10114
  Gene Symbol: MPPED2
  Gene Name: metallophosphoesterase domain containing 2
  Uniprot ID: Q15777
  ENST ID: ENST00000358117
  CDS Start-End: 124-1008
agaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatggtcgaccccatcccatatgacactccaaaaccagcgggccacacgcggtttgtctgcatctcagacacacactccagaacagatggtatccagatgccttatggggacatccttctccacacaggcgatttcaccgagctgggactgccctcagaggttaagaagtttaatgactggttaggaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttggaccccgtggtttaatggatggggctttaacctacccagaggtcagtctctgctggacaagtggaacctcatccctgagggcattgacatactcatgacacatggacctcctctaggttttcgagactgggttccaaaggagcttcaaagagtgggctgtgtggagctgttaaacacggttcagaggcgagtccggcccaagctccatgtgtttggtggaatccatgaaggttatggcatcatgaccgacggttacacaacgtacatcaatgcctcgacgtgtacagtcagctttcaaccgaccaaccctccaattatatttgaccttccaaacccacagggttcctgaagctctaaatgccctattggaatgtgagggaaggtctataaactgccatttttctaattataaacttacattctcttacttatttacaaaccctgtgagttctttttgtaaattgttggaacacaaatgatgctagaggttgtgcttcttattttattttattttaaatggggcatccatttgaaatcagaggaacattgtgaatttgtaaaatgacttctgttttctcaaaggccatgccattgtaaattgttagtgttcgccaaaggacagccaagctttcttttaaaaagtgataaaagtcttattttaatatgctttaagctgaaagaaaaaaaaataagaaacaggcagtgttttaaaaaccaacacagatttgcacaactgtttaagagtattgtttgaaatattttaattttcaatgttttgttgttgttgttttcttggtaatgcttcttttttgcagatgtggtcccaatttatagcaatcttctcaacagaagtaggcatggaaaagacttcttttcatactctcactataaagaaagctgcattgagaagaaaatggctgtcatttaaaggatggtttaactagtgagattcctattgtggttatacaaggtctcattgtttgtttgtttcttttaaattatttcagctttaaaaatacagaaatggaatctgtcaagagcaggtatttcatacggttaaaaaaatgaacatgcagactccttttcaatatgggtttatatatataagtattttttgtgtattatgactacgttaggagtttattattgtcaaggacagtacaactgcaaagggatgctgtatagcaacacatcagaagtcggaaggaactgacacattctctcagagctcaaggtcttaaagagcttgagttaaatctaggtacagttacaggcatgtatagacttaaatggatgcaatggaagctaactaaaataaggcttagttgtcctttctatttaaataccccaagttgtcttcttacttcctctcccctctcccattttgcactgtgtgtcgatgcaatcttcgctagcacaaaatattgtcgctaatagtcatttctgttttcccattgtaaatgctgttgagctttattctattttatgttactttgttaatgaaatttaggaaagcagttgtttctttaaatttattgtgatattctatatctagcggcctttatatgcaaataaaattgcaagatttttaaattcgtgctgtttagagggttggatggtggaggatggtagtttcgtcctggggaaggagggatttattcatatgcaacatcagtaatgcctttcagaagaattagaataagtgatttttttccctaattttcaataaatttttattacccacca

SEQ ID NO: 153089 - DNA, 5591 bp, Homo sapiens
  Payload ID: 10114
  Gene Symbol: MPPED2
  Gene Name: metallophosphoesterase domain containing 2
  Uniprot ID: Q15777
  ENST ID: ENST00000448418
  CDS Start-End: 362-1195
cccagatcgaggctgctcgggtcctttctccccccgcctccctctagcgccgcgccccctggcccccagccccagcctgcggcgggacctccggggtcgaaggttctggcccgctcgcgcccctcgccgcccccgcgcgcccccagcgctcctccagccggctcgggccgctcggctatggatcgcctgctcgccgggcgctgaaggcatccccgggatccggagcgcagcccgggaaagaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatggtcgaccccatcccatatgacactccaaaaccagcgggccacacgcggtttgtctgcatctcagacacacactccagaacagatggtatccagatgccttatggggacatccttctccacacaggcgatttcaccgagctgggactgccctcagaggttaagaagtttaatgactggttaggaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttggaccccgtggtttaatggatggggctttaacctacccagaggtcagtctctgctggacaagtggaacctcatccctgagggcattgacatactcatgacacatggacctcctctaggttttcgagactgggttccaaaggagcttcaaagagtgggctgtgtggagctgttaaacacggttcagaggcgagtccggcccaagctccatgtgtttggtggaatccatgaagtaaaccctgtgagcatctccaaggcactgaggacaaaaatatgttctctgccttcaaaaacttcctagtctagaggaaactggcatagacacaattaattgatgatctgatgaattagcattgtgtgagctacaatcctggcatgaatcaagaactagagaggcacacaggaaggaaggaagatgcctctccttggtgaagacaaagaaggcatgaggaggaggcgacagggaagctcacctggtggacaacaggaaagactgcggaggagggctctgctggaagaggaaacagactggggaggtggggccagtgcataaagggccactgcaggaaggggttgtaggagaaaaggaaagacagatcagtcactgatgaccccctccaccccaggtctgcagacagagctgattccttctctaagcctcggcatcccctaccaacagtccctcctgctccttctctcccaagtcctctaaacagcttcatgcccaaaccacaaagagaacattctcaggcctaaggcaggccttcccagcacagaatgtttggagccctctgtgggagagcggctggcccccttaactgtcccccttccctccgggagccaaggcaggcactgtgcacctgcccctgaattgtgtgcggcagttgccggcctggagctgagtgacacagcaggtgcctccagcctgaagacaattccatatttcaatggagcgtcgccaccaaagcttattatctagggcaataaagtttaggattagggggattcaggatgattgtgtgattctccacaaagcttatcttctaatagaccagctgctttattaggccgcccccacccgcaccaggcccttcccaaagcatcccaagtcccaggcagccgacgggggccttgaaggcggcagtggtagacagctgggggtatcatatcaccctcagtctccatctgcgattattaaattacgggcggcttccagctgggcacaccccagctcccaccttcctcctacaaagccagcatcatcgtcaggcatctgccaaggacacgatgtggctgcctctcccctgctgatccctactgttgaactctaaaagggccaggtctgggtatttacttgctattagggctgtcactgtcacagtgtggaatgcagtggagtggaggcctggagagagggggggaccatggaaatttctgttgcaaatggggctttgctgggactgttcactataaacaaaaaaagaagatggaatcatgcaccacagaacctcaaagaagctggcatgcttaccaagctcccacatatttctcccaaaatgaaattcattaacgttgagtgttctagggaccacctccacatgctccctgatcccattgctccgttccttttctgatgggagcagagcatgggatggtgtctctccaaccccgtgtggtcagcagcactgaggctactctcgtttcctatccctccctgacagtctcctttatcctcagcccctgacagactatctgttcagagtaggaatttatcaataagtactgataagcatgctgaaaggaatatgggggactgggaatatgcctgaaacataatgaatgtttcaaagaaatgaaacgttctgaaaatggaattttcaaagattctgacaagcacacagcatctgcttgcagattttaggaaaacttagtcatagaattattcagagttcacatttcagccatggggatgttgtgtgcctgttgacagcagaggtccctgtagacgtttgttttttactgtgtctatgtgtgattcactaatgagagagtggcttagatgctcagagtaattaattgtagtattgagataatagtggctttgaaatccagctgtgcttatatgcgtgcacgctgtgcagttagatgctcccaggttcagatctgcttccatcactactaactatgtggccttgttttctgatctgcaagccatggattgtattgcttactttgcgggactgtggtaaacgttaggcatatatgaggcaagtgcaatgcccaacatttggcagatgcttaataagtgttggctattattattactactactactactattgcttttgctattgctattatgtgtgacctgtataataatcctactaatatgagtgaaggcaagaatcatggactatgcacccagcataatcaggagggtttgactgttgtgaatgaattcaagggcaggacaagcagcgacaagagttactgaagttcatctgatttgagttctgttcattcatttatttgggatccaaattctgaaccccagctctgtgctagacactgttctaggtgctgggaaaacagtcatgtgttagtctgtttttgctgccataaaggaatccctgagactgggtattttataaagaaaagaggtttatttaaatcacagttctgcaagcctaacacctggtggaagctgccaaggcttacagcttataccctctcaagcagcaccctaatctataccttgagccaagactggaattggagctgccatgatgcaggaagcagtgtcccaaggatgtgcagagcagtggggtcctgaatgtggccccccaaaccattcttttctcctaggcctctaggcctgtgatgggggggtggccttgaaaatctctgaaatgccttcaaggcctttttcccattgtcttggttattagcacttggctcccctttagccatgctaatctgtctagcaagtggttgctccacagcctgctcatatttcactcctgaaaatgttctttccttctccaccacacaaccagtttgtgaattttccaaacttttatgctctgcttcccttttaattatcaatttcccagcctcagatattcctttatagtaatgcaaatggactaacagaagcaatgaataagaaggggtcctggcccctctacaactcatcttctattgagaaagaaagaagaaaaaatgaaaataagttaaaaaaactcaaattttgataaaccctatgaagaaaataagaaatgggatagaagttagctggcatggcagggtggagtgggtgagtgacattaaggagggtgacaacagagaaactttctgataaaaaacccagtaagtaaaggtctaagtgatgtggatgaggcagccacttgaagacctgggacaaaagtgttcaggcagagaatatagcaggtacagagctttttgtataagaaggtagcaaaaaggccagtatagccagagaacagaggaggtaaggagaaagataggggatgaggcaggtgctaactcatcaacatccttgcaggccttgatgagagttaagatttcattataattgcaataagaagacagtggaaggttttttggcgggggtgggggtggtcaatgacatgattggattgatatgttggaaaagcccatctggcgactgtgttcagtaacagtgtgcttgcatgaagatccctcacagcagcagacaacacaaatgccccctcccacccatcatgaaaatttggaaagccaagccaataggaaactgaagctacaaagacccagcccctagaaagcaatataaacaagaccagaaaaagcatgtgttcaggacaagttcacattgaagtaaaaccatattgacattgattgcattccctacctgcttaggggttttgcttcacctaaactagtaccttgagaatctgtaaaagcttacaatttgagaaaagcaagagatgacacctgattatcctttgaattggcttccatgtctgtggctgttttccctaagttcctgtcccttacacacacgttacaaaactttgtctcaattctttgcttttaaaggatttgactttaacaaattcacattgggtacttgcttagtaggaaaggaaataatgactctcaccccctatgttataaaacttttaggagtattacacacaggcacatacagggcacactggtatggcttgtcattttgtgacaaattcttgtcagtttgtggtctggtggaaagcatatggaattagcaatcaagaaaggtgagatttagttctggctctgcttctaactagcaatgcaatcttggacaagagatttattctttcaagtctcagtttcatcttgtcatatggacatagagtgatacttccttttaaaagaacctgggtatcctggccaggcgcggtggctcatgcctcccagcactttgggaggccgaggcgggtggatcacaaggtcaggagatcgagaccatcctggccaacatggtgaaaccccgtctctactaaaaatacaaaaattagttgggcgtggtagtcccagctactcgggagactgaggcaggagaatttcttgaaccctggaggcggaggtagcagtgagccccgaggtcgtgccactgaactccagcctggcaacagagcgagactctgtct

SEQ ID NO: 153090 - DNA, 497 bp, Homo sapiens
  Payload ID: 10114
  Gene Symbol: MPPED2
  Gene Name: metallophosphoesterase domain containing 2
  ENST ID: ENST00000528686
  CDS Start-End: 253-497
agatcagcagatgggagggaacctagggtcgccttcctaggtctgagcgaagtgtcccagccgctccccttacccctgcggtgagccctgcgtcctggaacggtgccaggactcctgacagagcctggcagaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatggtcgaccccatcccatatgacactccaaaaccagcgggccacacgcggtttgtctgcatctcagacacacactccagaacagatggtatccagatgccttatggggacatccttct

SEQ ID NO: 153091 - DNA, 1469 bp, Homo sapiens
  Payload ID: 10114
  Gene Symbol: MPPED2
  Gene Name: metallophosphoesterase domain containing 2
  ENST ID: ENST00000526437
  CDS Start-End: 200-553
tccggagaaaagtcttgccctccctctccgaaagaatgtgtcacccgggtgtccgcagtgctggagacaagttcaggtaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatggtcgaccccatcccatatgacactccaaaaccagcgggccacacgcggtttgtctgcatctcagacacacactccagaacagatggtatccagatgccttatggggacatccttctccacacaggcgatttcaccgagctgggactgccctcagaggttaagaagtttaatgactggttagacctggtttcccattgcaagcatggaagaaaccctaatgcatgagtttcagaggagaaggtagcagtctgaacctgctgtgtggctccatcagcaagtgaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttggaccccgtggtttaatggatggggctttaacctacccagaggtcagtctctgctggacaagtggaacctcatccctgagggcattgacatactcatgacacatggacctcctctaggttttcgagactgggttccaaaggagcttcaaagagtgggctgtgtggagctgttaaacacggttcagaggcgagtccggcccaagctccatgtgtttggtggaatccatgaaggttatggcatcatgaccgacggttacacaacgtacatcaatgcctcgacgtgtacagtcagctttcaaccgaccaaccctccaattatatttgaccttccaaacccacagggttcctgaagctctaaatgccctattggaatgtgagggaaggtctataaactgccatttttctaattataaacttacattctcttacttatttacaaaccctgtgagttctttttgtaaattgttggaacacaaatgatgctagaggttgtgcttcttattttattttattttaaatggggcatccatttgaaatcagaggaacattgtgaatttgtaaaatgacttctgttttctcaaaggccatgccattgtaaattgttagtgttcgccaaaggacagccaagctttctttt

SEQ ID NO: 153092 - DNA, 396 bp, Homo sapiens
  Payload ID: 10115
  Gene Symbol: MT1A
  Gene Name: metallothionein 1A
  Uniprot ID: P04731
  ENST ID: ENST00000290705
  CDS Start-End: 74-259
accaagccttccacgtgcgccttatagcctctcaacttcttgcttgggatctccaacctcaccgcggctcgaaatggaccccaactgctcctgcgccactggtggctcctgcacctgcactggctcctgcaaatgcaaagagtgcaaatgcacctcctgcaagaagagctgctgctcctgctgccccatgagctgtgccaagtgtgcccagggctgcatctgcaaaggggcatcagagaagtgcagctgctgtgcctgatgtccggacagccctgctcgaagatatagaaagagtgacctgcacaaacttggaattttttttccatacaaccctgacccatttactgtattttttttaatgaaatatgtgaatgataataaaagttgctgacttaa

SEQ ID NO: 153093 - DNA, 411 bp, Homo sapiens
  Payload ID: 10115
  Gene Symbol: MT1A
  Gene Name: metallothionein 1A
  Uniprot ID: P04731
  ENST ID: ENST00000622334
  CDS Start-End: 74-259
accaagccttccacgtgcgccttatagcctctcaacttcttgcttgggatctccaacctcaccgcggctcgaaatggaccccaactgctcctgcgccactggtggctcctgcacctgcactggctcctgcaaatgcaaagagtgcaaatgcacctcctgcaagaagagctgctgctcctgctgccccatgagctgtgccaagtgtgcccagggctgcatctgcaaaggggcatcagagaagtgcagctgctgtgcctgatgtccggacagccctgctcgaagatatagaaagagtgacctgcacaaacttggaattttttttccatacaaccctgacccatttactgtattttttttaatgaaatatgtgaatgataataaaagttgcttgcttaaaaagaaaccaaaggg

SEQ ID NO: 153094 - DNA, 380 bp, Homo sapiens
  Payload ID: 10116
  Gene Symbol: MT1B
  Gene Name: metallothionein 1B
  Uniprot ID: P07438
  ENST ID: ENST00000334346
  CDS Start-End: 56-241
cctgccctgacttctcatatcttgcctaggaactccaggcttgtcttggctccaaatggatcccaactgctcctgcaccacaggtggctcctgtgcctgcgccggctcctgcaagtgcaaagagtgcaaatgtacctcctgcaagaagtgctgctgctcttgctgccccgtgggctgtgccaagtgtgcccagggctgtgtctgcaaaggctcatcagagaagtgccgctgctgtgcctgatgttgggagagccctgctcccagacataaatagagcaaccagtactaacctggatttttttttttaactaccctgaccggtttgctacattcttttttctattcaatatgtgaaagacaataaaacacttttgacttga

SEQ ID NO: 153095 - DNA, 351 bp, Homo sapiens
  Payload ID: 10116
  Gene Symbol: MT1B
  Gene Name: metallothionein 1B
  ENST ID: ENST00000562399
  CDS Start-End: 29-241
aggaactccaggcttgtcttggctccaaatggatcccaactgctcctgcaccacaggtggctcctgtgcctgcgccggctcctgcaagtgcaaagagtgcaaatgtacctcctgcaagaagctgctgctcttgctgccccgtgggctgtgccaagtgtgcccagggctgtgtctgcaaaggctcatcagagaagtgccgctgctgtgcctgatgttgggagagccctgctcccagacataaatagagcaaccagtactaacctggatttttttttttaactaccctgaccggtttgctacattcttttttctattcaatatgtgaaagacaataaaacacttttgacttga

SEQ ID NO: 153096 - DNA, 704 bp, Homo sapiens
  Payload ID: 10117
  Gene Symbol: MT1E
  Gene Name: metallothionein 1E
  Uniprot ID: P04732
  ENST ID: ENST00000306061
  CDS Start-End: 378-563
cggaacacgctgggaggagggtggaaggcaacctcggggaaactgggaaaggcggcctggacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 153097 - DNA, 729 bp, Homo sapiens
  Payload ID: 10117
  Gene Symbol: MT1E
  Gene Name: metallothionein 1E
  Uniprot ID: P04732
  ENST ID: ENST00000330439
  CDS Start-End: 55-438
cctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagtgagtgcggggccatctccaggaatctggggctgtggctcaggttgggagggaactcaaggctggccctgagtgcatccttctggggaactgggctttctttgccctcattgcccgtgtcattccctctccaggctttctgccctaaattcagatggggcaggacagcatttttctcgtgggacacaaaccccaactgtaccccctatggtttcagaacagagctgtgccagacgaaaaaaagcatcctctgggtctgggttctgagctcgagccaggcttgctattagggcagggaggtgcccggtcaagtctactgccacctctcactctccccttcttccccaggctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 153098 - DNA, 332 bp, Homo sapiens
  Payload ID: 10117
  Gene Symbol: MT1E
  Gene Name: metallothionein 1E
  ENST ID: ENST00000568293
  CDS Start-End: 72-191
attctgctttccaactgcctgactgcttgttcgtctcactggtgtgagctccagcatcccctttgctcgaaatggaccccaactgctcttgcgccactggctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 153099 - DNA, 690 bp, Homo sapiens
  Payload ID: 10118
  Gene Symbol: MT1F
  Gene Name: metallothionein 1F
  Uniprot ID: P04733
  ENST ID: ENST00000334350
  CDS Start-End: 366-551
caaggggcgggtgtagcaggcaatcttggcgaaactgggaagggcgggcaggagggcagggaagccgctcacccaggcacaaagcgcctcccgcttgagcggactccaaagggacggtccgcggtgtgcagcgagctgcgctcaggggaccttgcgcccggcccttctgctgcacacagcccacccaggacctcccgcagcgctgacaggcggggcgggtgcaaagacggggcggggtctctgcgcccggccccctcccctgactatcaaagcagcggccggctgttggggtccaccacgccttccacctgccccactgcttcttcgcttctctcttggaaagtccagtctctcctcggcttgcaatggaccccaactgctcctgcgccgctggtgtctcctgcacctgcgctggttcctgcaagtgcaaagagtgcaaatgcacctcctgcaagaagagctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctga

SEQ ID NO: 153100 - DNA, 416 bp, Homo sapiens
  Payload ID: 10118
  Gene Symbol: MT1F
  Gene Name: metallothionein 1F
  ENST ID: ENST00000568475
  CDS Start-End: 48-182
gcttcttcgcttctctcttggaaagtccagtctctcctcggcttgcaatggaccccaactgctcctgcgccgctggtgtctcctgcacctgcgctggttcctgcaagtgcaaagagtgcaaatgcacctcctgcaagaagagtgagtgtgaggccatctccatggtctggggctgtggctaaggctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctgatt

SEQ ID NO: 153101 - DNA, 405 bp, Homo sapiens
  Payload ID: 10119
  Gene Symbol: MT1G
  Gene Name: metallothionein 1G
  Uniprot ID: P13640
  ENST ID: ENST00000379811
  CDS Start-End: 73-261
actccgccttccacgtgcacccactgcctcttcccttctcgcttgggaactctagtctcgcctcgggttgcaatggaccccaactgctcctgtgccgctgcaggtgtctcctgcacctgcgccagctcctgcaagtgcaaagagtgcaaatgcacctcctgcaagaagagctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttga

SEQ ID NO: 153102 - DNA, 406 bp, Homo sapiens
  Payload ID: 10119
  Gene Symbol: MT1G
  Gene Name: metallothionein 1G
  Uniprot ID: P13640
  ENST ID: ENST00000444837
  CDS Start-End: 73-258
actccgccttccacgtgcacccactgcctcttcccttctcgcttgggaactctagtctcgcctcgggttgcaatggaccccaactgctcctgtgccgctggtgtctcctgcacctgcgccagctcctgcaagtgcaaagagtgcaaatgcacctcctgcaagaagagctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttgattcc

SEQ ID NO: 153103 - DNA, 305 bp, Homo sapiens
  Payload ID: 10119
  Gene Symbol: MT1G
  Gene Name: metallothionein 1G
  ENST ID: ENST00000569500
  CDS Start-End: 42-161
tcccttctcgcttgggaactctagtctcgcctcgggttgcaatggaccccaactgctcctgtgccgctggctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctacaatcttgacccctttgctacattcctttttttctgtgaaatatgtgaataataattaaacacttagacttga

SEQ ID NO: 153104 - DNA, 628 bp, Homo sapiens
  Payload ID: 10119
  Gene Symbol: MT1G
  Gene Name: metallothionein 1G
  ENST ID: ENST00000568675
  CDS Start-End: 29-235
gggaactctagtctcgcctcgggttgcaatggaccccaactgctcctgtgccgctggtgtctcctgcacctgcgccagctcctgcaagtgcaaagagtgcaaatgcacctcctgcaagaagagtgagtgcggggccatctccaggaatctggggctgtggctaaggttgggagggaacccaaggctgtccctgagtgcgtgcttctggggaaccggccttcctttgtccctgtaggttgtcactgcctgtctagtcttctgcactttccagggcttatgtgaggtggggcagctttctcaaaggaagacccattccaatgtccaccagttgtctcctgacaaaaaccatgccatcatgaactaagggtcctctggggctggagggatggagacaggcctctgttggggcagggagttctctgatcgagtctgctctgacctctcaatctcctttcctccccaggctgctgctcctgctgccctgtgggctgtgccaagtgtgcccagggctgcatctgcaaaggggcatcggagaagtgcagctgctgcgcctgatgtcgggacagccctgctcccaagtacaaatagagtgacccgtaaaatccaggattttttgttttttgctaca

SEQ ID NO: 153105 - DNA, 397 bp, Homo sapiens
  Payload ID: 10120
  Gene Symbol: MT1H
  Gene Name: metallothionein 1H
  Uniprot ID: P80294
  ENST ID: ENST00000332374
  CDS Start-End: 72-257
accacgccctccacgtgttccactgcctcttctcttctcgcttgggaactccagtctcacctcggcttgcaatggaccccaactgctcctgcgaggctggtggctcctgcgcctgcgccggctcctgcaagtgcaaaaagtgcaaatgcacctcctgcaagaagagctgctgctcctgttgccccctgggctgtgccaagtgtgcccagggctgcatctgcaaaggggcgtcagagaagtgcagctgctgtgcctgatgtcgggacagccctgctgtcagatgaaaacagaatgacacgtaaaatccaggattttttttttctacaactccgactcatttgctacattcctttttttctgtgaaatatgtgaataataattaaacacttagacttga

SEQ ID NO: 153106 - DNA, 697 bp, Homo sapiens
  Payload ID: 10120
  Gene Symbol: MT1H
  Gene Name: metallothionein 1H
  ENST ID: ENST00000569155
  CDS Start-End: 46-303
ctcttctcttctcgcttgggaactccagtctcacctcggcttgcaatggaccccaactgctcctgcgaggctggtggctcctgcgcctgcgccggctcctgcaagtgcaaaaagtgcaaatgcacctcctgcaagaagagtgagtgcggggccatctccaggaatctggggctgtggctaaggttgggagggaacccaaggctggccctgagtgcctgcttcctttgtccccctaggccgtcactgcctttccagtcttctgctctgtccagggctcctgtggggctgggcagtctctcataggaagactcaccccaatatccaccagtcgtctcctgaaaaagctgtgccatcctgaactaaggatcctctggggctggagtctgagcttgagccaggcctgctgttgggagagggagctccctggtcaagtctgctgtgacttctctctccctttttccccaggctgctgctcctgttgccccctgggctgtgccaagtgtgcccagggctgcatctgcaaaggggcgtcagagaagtgcagctgctgtgcctgatgtcgggacagccctgctgtcagatgaaaacagaatgacacgtaaaatccaggattttttttttctacaactccgactcatttgctacattcctttttttctgtgaaatatgtgaataataattaaacacttagacttga

SEQ ID NO: 153107 - DNA, 316 bp, Homo sapiens
  Payload ID: 10121
  Gene Symbol: MT1HL1
  Gene Name: metallothionein 1H-like 1
  Uniprot ID: P0DM35
  ENST ID: ENST00000464121
  CDS Start-End: 47-232
cctcttctcttctcgcttgggaacgccggtctcacctcggcttgcaatggaccccaactgctcctgcgccgctggaggctcctacgcctgcgccggctcctgcaagtgcaaaaagtgcaaatgcacctcctgcaagaagagctgctgctcctgttgccccctgggctgtgccaagtgtgcccagggctgcatccgcaaaggggcttcggaaaagtgcagctgctgtgcctgatgtcgggactgccctgctctcggatgaaaacagaatgacacgtaaagtccgggatttttttttctacaaccccgacccatttgc

SEQ ID NO: 153108 - DNA, 829 bp, Homo sapiens
  Payload ID: 10122
  Gene Symbol: MT1M
  Gene Name: metallothionein 1M
  Uniprot ID: Q8N339
  ENST ID: ENST00000379818
  CDS Start-End: 500-685
cggggactggagcaggagggctgcaccgggactccgggacaggcccagttgaaaacggcggggcgagggggtggggtggagacgcccgcgacgccaaggctggggtcccggaaagcgcggggaggagggtggaaggcaaaggcaacttcggggaaactgggaaaggcggccgggacctcggggacactgcgtaccacccggcgcacagcccctcccgcgcaaacccgagccaaaggggcggtcgagcggcgcactcggagcggagctcaggggatggtgcgcccggcacttatgctgggctcagcccagcccagcccaggaccgctggcggtgcgaacccagccgggcgggtgcaagcgcggggcagggcctctgcgcccggccccctcccctgagtagaaaagcagccgcaggctgtggcgctccaccacgccgtccgggtgggcctagcagtcgctccatttatcgcttgagatctccagccttaccgcggctcgaaatggaccccaactgctcctgcaccactggtgtctcctgcgcctgcaccggctcctgcacgtgcaaagagtgcaaatgcacctcctgcaagaagagctgctgctcctgctgccccgtgggctgtgccaagtgtgcccacggctgtgtctgcaaagggacgttggagaactgcagctgctgtgcctgatgtgggaacagctcttctcccagatgttaatagaacaagctgcacaacctggattttttttcaatacgatactgagccatttgctgcatttctttttatattaaatatgtgagtgacaataaaacaattttgacttgaatctta

SEQ ID NO: 153109 - DNA, 232 bp, Homo sapiens
  Payload ID: 10122
  Gene Symbol: MT1M
  Gene Name: metallothionein 1M
  ENST ID: ENST00000570233
  CDS Start-End: 26-232
atctccagccttaccgcggctcgaaatggaccccaactgctcctgcaccactggtgtctcctgcgcctgcaccggctcctgcacgtgcaaagagtgcaaatgcacctcctgcaagaagagtgagtgcggggccatctccaggaatctggggctgtggctgagattgggagggaacccaaggctggccctgagtgcatccttctggggaactgggctttctttgccctcattg

SEQ ID NO: 153110 - DNA, 450 bp, Homo sapiens
  Payload ID: 10123
  Gene Symbol: MT1X
  Gene Name: metallothionein 1X
  Uniprot ID: P80297
  ENST ID: ENST00000394485
  CDS Start-End: 118-303
ggccctcttcccggactataaagagagccgccggcttctgggctccaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttttttttttgtacaaccctgacccgtttgctacatctttttttctatgaaatatgtgaatggcaataaattcatctagacta

SEQ ID NO: 153111 - DNA, 549 bp, Homo sapiens
  Payload ID: 10123
  Gene Symbol: MT1X
  Gene Name: metallothionein 1X
  ENST ID: ENST00000564974
  CDS Start-End: 61-201
catctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagtgagtgcagggccttccctgcgaatctgggggatgggccaagttagagcagggaacccagagctctgcaggcaggggcaggccaatgaccagcttccccaaacccctccttcaacacctgattcagaatcagacctcaaattgccttaaaaatgggctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggattttttttttttttttttttgtacaaccctgacccgtttgctacatctttttttctatgaaatatgtgaatggcaataaattcatctagacta

SEQ ID NO: 153112 - DNA, 538 bp, Homo sapiens
  Payload ID: 10123
  Gene Symbol: MT1X
  Gene Name: metallothionein 1X
  ENST ID: ENST00000562939
  CDS Start-End: 72-212
accacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagtgagtgcagggccttccctgcgaatctgggggatgggccaagttagagcagggaacccagagctctgcaggcaggggcaggccaatgaccagcttccccaaacccctccttcaacacctgattcagaatcagacctcaaattgccttaaaaatgggtgagtcccagcctcttattaccaaactagaaactgaggcccagagaggttaccagatagtgttgggaacaaagctggaatgtgaacctaggtctcctgcctcctgatgcagccttcttcacccttctgggtcctgaagcacttaaggcccaggatctggaagaccccgggtgatttcaaacctaatgatccagtcctttcctgcaggggtagccca

SEQ ID NO: 153113 - DNA, 786 bp, Homo sapiens
  Payload ID: 10124
  Gene Symbol: MT2A
  Gene Name: metallothionein 2A
  Uniprot ID: P02795
  ENST ID: ENST00000245185
  CDS Start-End: 458-643
aagcagcattcccaagtcccgctttcacccgcgcgctaacggctcaggttcgagtacaggacaggagggaggggagctgtgcacacggcggaggcgcacggcgtgggcacccagcacccggtacactgtgtcctcccgctgcacccagccccttccgcgccgaggcgtccccgaggcgcaagtgggccgccttcagggaactgaccgcccgcggcccgtgtgcagagccgggtgcgcccggcccagtgcgcgcggccgggtgtttcgcctggagccgcaagtgactcagcgcggggcgtgtgcaggcagcgcccggccggggcggggcttttgcactcgtcccggctctttctagctataaacactgcttgccgcgctgcactccaccacgcctcctccaagtcccagcgaacccgcgtgcaacctgtcccgactctagccgcctcttcagctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 153114 - DNA, 581 bp, Homo sapiens
  Payload ID: 10124
  Gene Symbol: MT2A
  Gene Name: metallothionein 2A
  ENST ID: ENST00000561491
  CDS Start-End: 51-272
gcgaacccgcgtgcaacctgtcccgactctagccgcctcttcagctcgccatggatcccaactgctcctgcgccgccggtgactcctgcacctgcgccggctcctgcaaatgcaaagagtgcaaatgcacctcctgcaagaaaagtaagtgggatcctctctttcctctaccccttccctgtcctccagcctgtcccctctccaccatcctcaggggaattaaagcagtctggggatgccccattgcgcggaaattgttgcctcctcagtgatccttatcagggagagcaggaatccttattcccggtgtcgctagtactcatctctgccgcctcctgtctgcccccaggctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgact

SEQ ID NO: 153115 - DNA, 569 bp, Homo sapiens
  Payload ID: 10125
  Gene Symbol: MT3
  Gene Name: metallothionein 3
  Uniprot ID: P25713
  ENST ID: ENST00000200691
  CDS Start-End: 224-430
acacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagcatga

SEQ ID NO: 153116 - DNA, 514 bp, Homo sapiens
  Payload ID: 10125
  Gene Symbol: MT3
  Gene Name: metallothionein 3
  ENST ID: ENST00000561640
  CDS Start-End: 47-388
ttcagcaacccgtctgaacagatctggcgtcctggagaattctagaatgaaggggaagagaggcagggaagagctgggaaatacgcaaagcgcctttttctccactttcggagatgccaagccgcgcgtccagttgcttggagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatccc

SEQ ID NO: 153117 - DNA, 421 bp, Homo sapiens
  Payload ID: 10125
  Gene Symbol: MT3
  Gene Name: metallothionein 3
  ENST ID: ENST00000565838
  CDS Start-End: 47-292
ttcagcaacccgtctgaacagatctggcgtcctggagaattctagaatgaaggggaagagaggcagggaagagctgggaaatacgcaaagcgcctttttctccactttcggagatggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatg

SEQ ID NO: 153118 - DNA, 579 bp, Homo sapiens
  Payload ID: 10125
  Gene Symbol: MT3
  Gene Name: metallothionein 3
  ENST ID: ENST00000570176
  CDS Start-End: 52-330
cagttgcttggagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagtgagtgcggggacccttcccctctgccgccgccccctctgctctgcggagtcggtgtctcaccacgcaggatgtggagagacagccaggccccgatcccgtggtttctgactcttgctggaatagaaccacccgggcagacattaaaatacagatgcccctgccccacacccaggaattgatggcctaggcgtgggacgagaggtttttgtaaatccccagaagactccaatggcagctgggattgaggactgccacactggtccaacctttcccgacccatccctcaaaaactccccaaaacctggggaagccattagtgaggctgcggctcagctctggagttccggtcccttggcctctctccggccttacggatcctctcagtttgatctcaaaatctccccagctcacggcagtgtaatatgcat

SEQ ID NO: 153119 - DNA, 294 bp, Homo sapiens
  Payload ID: 10126
  Gene Symbol: MT4
  Gene Name: metallothionein 4
  Uniprot ID: P47944
  ENST ID: ENST00000219162
  CDS Start-End: 81-269
atggggagcctctggctgctgctcactcagcctcccttccccagccgtgacagcactggagcctttcggacacctggaccatggaccccagggaatgtgtctgcatgtctggaggaatctgcatgtgtggagacaactgcaaatgcacaacctgcaactgtaaaacatattggaagagctgctgtccctgctgccccccgggctgtgccaaatgtgcccggggctgcatctgcaaaggaggctcagacaagtgcagctgctgcccatgaaagccatccatcgtgcccacccctt

SEQ ID NO: 153120 - DNA, 2579 bp, Homo sapiens
  Payload ID: 10127
  Gene Symbol: MTL5
  Gene Name: metallothionein-like 5, testis-specific (tesmin)
  Uniprot ID: Q9Y4I5
  ENST ID: ENST00000255087
  CDS Start-End: 185-1711
actgcccgggcgcctcttcccctccccccaggttcctgtccctcacccttcccccttctccaaccgccaacggccgcctgcgcctgaggcccggcccacgccccatcccgctcgctccacgctgcggcagccccggcggccccaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctgggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagatgtccctaaaccaatgactgctttagtagggagatttttgccagcatcaacaaaattaaatctcattacacaacaacttgagggagccttaccatcggtagtcaacgggtctgctttcccctcgggatcaactcttccaggaccaccaaaaataactttggctgggtactgtgactgctttgccagtggggacttttgcaacaactgcaattgtaataattgttgcaacaacttgcatcatgatattgaacggtttaaagccattaaggcatgtcttggtagaaatccagaagctttccagccaaaaattgggaagggccaattgggcaatgtcaagccccagcacaacaaagggtgcaactgcaggaggtcaggctgcctgaagaattactgcgagtgctatgaggcccaaattatgtgttcttctatttgcaaatgcattggttgcaaaaattatgaagaaagcccagaacgaaagacactaatgagcatgccaaactacatgcagactggaggtttggaaggcagccattacctgccaccaacgaaattttcaggacttccaagattcagtcacgataggcggccttcctcatgcatctcctgggaggtggtggaggccacatgcgcctgcctgcttgctcagggagaagaggccgagaaagaacactgctccaagtgcctggcagagcagatgatcctggaggaatttggaaggtgcttatcacagattctccacactgagtttaaatctaagggattgaaaatggagtagagtataaagtgtgaatgcatgttgattttgtcttagtctagaaatctctagtttagaaaggatgtttaggggaacatgaggctggctctgcagcaacaaccaggctcccctgcatccctgggcccagggagtttactcagagctctctgaagatgtggcaacccatgcccccttttctgaggaggtgcatggcctgagcattgtttgtctggcccagaggagagagcttgggttcccatagtcctgggagagtgtctgcagggcggcggagggcagagcagggcaggggagggcacagcaggccctgcgaagggcagagcggggcaggggagggcagagcaggccctgcggagagctcactctggtcgactcttcctctcagagaatgttgctctggaggctgctctgcatgaaaaccctaatggtttcttgtttgtttttcaaattatttagaaataagttctccggatgggctgttgtgataccacttaaaatctctagagaactactgaacacctaaagattttctgtagcgtagatatttccccagaggcacgcgaactgtcagtctttcctaaggcccccgggagacgcaggcaatggggcctcgcaggccaggcttgcaccagcatgtcttgagttagaggacttaaaattatccagtttcttctgtgtttctacttgaattgtggaaaagctctattatccaattaacttctccataattattgttgtaatattattattgtttgtaaaacatggttcacataactagcttgtggaaaccagcaggtaaaatgaattcttaagttgacgcttttggttctgttgtaaagcaaagatgaataaaaatttccaatgtcttcaa

SEQ ID NO: 153121 - DNA, 3495 bp, Homo sapiens
  Payload ID: 10127
  Gene Symbol: MTL5
  Gene Name: metallothionein-like 5, testis-specific (tesmin)
  Uniprot ID: Q9Y4I5
  ENST ID: ENST00000443940
  CDS Start-End: 88-843
acgccccatcccgctcgctccacgctgcggcagccccggcggccccaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctgggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagcttgagggagccttaccatcggtagtcaacgggtctgctttcccctcgggatcaactcttccaggaccaccaaaaataactttggctgggtaaggattagaagcaatacattgtcactctaatgtaataatttaagagactcttggatacgttcacgattttcttctatactataaaatgagcttcactgcacaccttcatgacttctgagaaatgtttttaccatcagcaatgccactaacggtgttgctgtctgtgtctggtttcactggggctgcaaaggctgctggaaagtctggcccataacctgcatctgtccctgtcctcctgtccgctgtcctatgttggtgtttctgaggcttgttgccatttatagctctttgtcttcattccatgttgattcaaactgtactggcctctcttttttgctgtcgtccgtggaaataatggtgtggcagccatgcagcatgaacggggggctgcagagtgccctccagctgcctccgcccgctgccttccatgctgagttggctcgagctctatggcaggtgctaatgcatgatctgtcttcacatctccaggtggacataggctgcacttatctgggacctcatcttgctatttcttgcctgtcttgtgtttataatcttgctatttcttgcctgtcttgtgtttataattgttgctaattaaactaatcagctggttgaaattatcaggttaacatttatgtattaacagtggtttgggcaaccctctccattcgttgagccctgtagttgattatggagatcagcatattcctgcctccaagaggtgtttgtttgtttgtttgttttttcttgttttttgtttgtttgtttgttttgtttttttgagacggactcttgctctgtcacccaggctggaatacaatggcatgatctctgctcactgcaacctccgcctcctgggttcaagcaattctccttcctcagcctcccgagtagctgggaccacaggcgcataccactataccaggctaatttttgtattttttagtagagactgggttttaccatgttggccaggctggtcttgaaatactgacctcagatgatccgcccatctcagcctcccaaagtgctgggattacaggcgtgcccggcctgcctgcaggagttctttgggcccacagtctaaggcaaacacataccctgggcctgagagacagcagtcaaacaccttacaggatacagcccgcagcctccagtgctttccaggctcctgcagagttctgccatcgggcatggcttcgtgatggccttggtaagtgtgaggagagtggtttggggctggaatgaaaggccgtgaatctggaaacacactggaaccgatcaacgctatcagccctcatggtcgctgaagggcgttggttgctcctgggcaccgctgcttcagtttctgcagtggctctttcagctgttgtaattctgtgcctaggctgttgacaacttttgctgagttggacagaataagactgtgggccatgctgcttgcttcactctctgggtgtgatggatcggtgagggtgcagttgctatgattgtaattggtcatctcatcatggctgttaacatttctggaccaaacaaaaatgacttcagctacttccagattctgctgatacattacacaggatgatctaaaaggctacagttctgaagatactcatctttcttgtaatctgggggcatctggtcaatagtattgcctctgtgctgtattgtgtctagaacattcaaggacatttgatacttctcatactttaattgcgtgctctcccagttgcagcaccctctgaggcttctatgtgttgcagccgatgggcatttgcacagagcagcagtcatgacagcgttttcagggcagctatttctccttttcccccttttcctctcccccggcttcccattctcctcctcctccttcctcttctcgtcccctcctcctcctctttgttctcctccccctgctcttcttcctctctccttttcctccttctgtgtctatactagattattttcaatcagtcacatgtttttctttattttgaatgttacaaaatatttctctattgtaaacggtgtgccaggaaaaacatgagatgtgtatttgtattttttatgcacataattacttaatccaatgcctctccacttaattgggcctgatgatttttatctcgacatctgcaatactgatgatatactggaatctctaccaatttatttttggtggtaagaaagcagtcagagaacgttttgctggttatttcattccgtgtgagttcccaaccaagactgtcagcccagtgtggttcagccatatctaacctatagaggccatagaagcagttcagcttaggctggaggccagcaggctgagtgtgcgagctgacccgatggtcatttgttagggttggggggtgaactggctaacttattaactagcttatcatattaataaaaactctttaatacaaatccttgtcctgacactctgtagctttaataatcctattaccaatctggtaataaatgtgaattctgacacattgttgatgctactggttttagtaacataatgaacatcataataaagaatattcaagagtc

SEQ ID NO: 153122 - DNA, 1235 bp, Homo sapiens
  Payload ID: 10127
  Gene Symbol: MTL5
  Gene Name: metallothionein-like 5, testis-specific (tesmin)
  Uniprot ID: Q9Y4I5
  ENST ID: ENST00000544963
  CDS Start-End: 81-1001
atcccgctcgctccacgctgcggcagccccggcggccccaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctgggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagatgtccctaaaccaatgactgctttagtagggagatttttgccagcatcaacaaaattaaatctcattacacaacaacttgagggagccttaccatcggtagtcaacgggtctgctttcccctcgggatcaactcttccaggaccaccaaaaataactttggctgggtaaggattagaagcaatacattgtcactctaatgtaataatttaagagactcttggatacgttcacgattttcttctatactataaaatgagcttcactgcacaccttcatgacttctgagaaatgtttttaccatcagcaatgccactaacggtgttgctgtctgtgtctggtttcactggggctgcaaaggctgctggaaagtctggcccataacctgcatctgtccctgtcctc

SEQ ID NO: 153123 - DNA, 843 bp, Homo sapiens
  Payload ID: 10127
  Gene Symbol: MTL5
  Gene Name: metallothionein-like 5, testis-specific (tesmin)
  ENST ID: ENST00000543240
  CDS Start-End: 1-614
gtgactgctttgccagtggggacttttgcaacaactgcaattgtaataattgttgcaacaacttgcatcatgatattgaacggtttaaagccattaaggcatgtcttggtagaaatccagaagctttccagccaaaaattgggaagggccaattgggcaatgtcaagccccagcacaacaaagggtgcaactgcaggaggtcaggctgcctgaagaattactgcgagtgctatgaggcccaaattatgtgttcttctatttgcaaatgcattggttgcaaaaattatgaagaaagcccagaacgaaagacactaatgagcatgccaaactacatgcagactggaggtttggaaggcagccattacctgccaccaacgaaattttcaggacttccaagattcagtcacgataggcggccttcctcatgcatctcctgggaggtggtggaggccacatgcgcctgcctgcttgctcagggagaagaggccgagaaagaacactgctccaagtgcctggcagagcagatgatcctggaggaatttggaagaaataagttctccggatgggctgttgtgataccacttaaaatctctagagaactactgaacacctaaagattttctgtagcgtagatatttccccagaggcacgcgaactgtcagtctttcctaaggcccccgggagacgcaggcaatggggcctcgcaggccaggcttgcaccagcatgtcttgagttagaggacttaaaattatccagtttcttctgtgtttctacttgaattgtggaaaagctctattatccaattaacttctccataattattgttgtaatattattattgt

SEQ ID NO: 153124 - DNA, 7972 bp, Homo sapiens
  Payload ID: 10128
  Gene Symbol: MTF1
  Gene Name: metal-regulatory transcription factor 1
  Uniprot ID: Q14872
  ENST ID: ENST00000373036
  CDS Start-End: 142-2403
ggaagtgacgttaggggaaggtgggggcaatcatggtgccgctggggaggggagaagctgctgctgccgccgttgccgggagccgcggagacaagtcattacgttttcatttctcacaactgggctgagcacaactgaaccatgggggaacacagtccagacaacaacatcatctactttgaggcagaggaagatgagctgacccccgatgataaaatgctcaggtttgtggataaaaacggactggtgccttcctcatctggaactgtttatgataggaccactgttcttattgagcaggaccctggcactttggaggatgaagatgacgacggacagtgcggagaacacttgccttttctagtagggggtgaagagggctttcacctgatagatcatgaagcaatgtcccagggttatgtgcagcacattatctcaccagatcagattcatttgacaataaaccctggttccacacccatgccaagaaatattgaaggtgcaaccctcactctgcagtcggaatgtccggaaacaaaacgtaaagaagtaaagcggtaccaatgtacctttgagggctgtccccgcacctacagcacagcaggcaacctgcgaacccaccagaagactcaccgaggagagtacacctttgtctgtaatcaggagggctgtggcaaagccttccttacctcttacagcctcaggatccacgtgcgagtgcacacgaaggagaagccatttgagtgtgacgtgcagggctgtgagaaggcattcaacacactgtacaggctgaaagcacatcagaggcttcacacagggaaaacgtttaactgtgaatctgaaggctgcagcaaatacttcaccacactcagtgatctgaggaagcacattcgaactcatacaggggaaaagccatttcggtgcgatcacgatggctgtggaaaagcatttgcagcaagccaccaccttaaaactcacgttcgtacacatactggtgaaagacccttcttctgccccagtaatggctgtgagaaaacattcagcactcaatacagtctcaaaagtcacatgaaaggtcatgataacaaaggacactcatacaatgcacttccacaacacaatggatcagaggatacaaatcactcactttgtctaagtgacttgagccttctgtccacagattctgaattgcgagaaaattccagtacgacccagggccaggacctcagcacaatttcaccagcaatcatctttgaatcaatgttccagaattcagatgatacggcaattcaggaagatcctcaacagacagcttccttgactgaaagttttaatggtgatgcagagtcagtcagtgatgttccgccatccacaggaaattcagcatctttatctcttccacttgtactgcaacctggcctctccgagccaccccagcctctactacctgcctcagctccgtctgctcctccgcctgctccctccctaggacctggctcccagcaagctgcatttggcaacccccctgctctcttacaacctccagaagtgcctgttccccacagcacacagtttgctgctaatcatcaagagtttcttccgcacccccaggcaccgcagcccattgtaccaggactttctgttgttgctggggcttctgcatcagcagcggcagtggcatcagctgtggcagcaccagccccaccacaaagtactactgagcccctgccagccatggtccagactctgcccctgggtgccaactctgtcctaactaataatcccacaataaccatcaccccaactcccaacacagctatcctgcagtccagcctagtcatgggagaacagaacttacaatggatattaaatggtgccaccagttctccacaaaaccaagaacaaattcagcaagcatctaaagttgagaaggtgttttttaccactgcagtaccagtagccagtagcccagggagctctgtccagcagattggcctcagtgttcctgtgatcatcatcaaacaagaagaggcatgtcagtgtcagtgtgcatgccgggactctgcaaaggagcgggcatccagcaggagaaagggctgctcctccccaccccctccagagccgagcccccaggctcctgatgggcccagcctgcagctcccagcgcagactttctcttcagcccctgttcccgggtcatcatcctctaccttgccctcctcctgtgagcaaagccgacaagcagagactccttcagaccctcagacagaaacattaagtgccatggatgtgtcagagtttctatccctccagagcctggacaccccgtccaatctgattcccattgaagcactactgcagggggaggaggagatgggcctcaccagcagcttctccaagtgaagggcccatgtgtgctcacctctgggaaaagcgggtgagcaggaggcatgaggtacaatgcctgccatcatgggtcagaaatttgaaggatgaagaaatctactgtttgaaatcctcacctttcagacgtattttctttattcacatcccaggagcatccattttaaggaactattctttggaaaaaaacaaaaaacaaaaaaaacaacaaaaaaagctaagttataagtgaactgtttggctgcactgtatgtcacttttgcttgttgtcatgtgaacttggaaactaaggttactcgtgtgcataaaaattctaaatgaaagggtgtggtttccatcaatctgatgctgcccatcgcttgcactggggtctttgtggatcgggcaggagttttcagtgtgttgggtgttgctccttcctatgtgtcttttgaatctgaggctgacatttgcttggaaggccagacccttgctccatcagagagggcagtggcaaaggccagtgaggcagctgtgagttggacagggttcaggtgagatggtgttgtcatttgtgcttagtgttggtggtgctcagggtggataacacgggtcgttctgcagcccgcttcagcacaaataggcagcttaaggcctggctcacaggctgtggggttgatctggctctgcagaggccctaggcagcttgttgactgctgtctgttgatgacgtgtgtgcaaagcaggctctagcaacatgatcactgtccttgccttcctggttctttctctcggttggttgccagggcttgcagatcgcagtgaattttccttggggaacatcgctgttttgtcctagagtgaacttgtggcttatggccagtgctgtttggtggtctgccttctttttaatggtattttcttcctcagagcagaagggctgcattttgcttatcagaagaaggtgcagatttaagggaattcatatgaggtggcatgtaattggcaggccaggtgtcctggttccaggttccagccaggctttgggttgccccctccatctctgcccccctctggattttgcatacagcctcatacagtgcaaacaaggatgtgacttgctcagcttagtcatgtgatttatttaaaaaaaaaaaaaaaagaaacacaaaacgatgatcttctactcagggtatagcaaaacaaaaaaattccctttccaccaaaaagcctgaaatgttgcaataagttatctcatttggaatgtttcattaagttgtgttataggaaaaaattgtgtgtgtgtgttatagaattatatccatatgtctgcctttggctccaagtcattgcctcttaaaataaaagatacaatccatactagcatgaaaagtttccctcaacaggctatattaacatagtcatgagtgctgaccaaactcaccgagctcagaggccaggcatggcctgaggtgcagaataggcctctgcctcccaagagccctttccttgccctgagcaaggagtggtgttccacaaacaaggctgctcttctaagccaacagtgtcaggcaggaagcagccataattttgccttgcattttcattccctaatgtaaagggatctgcattggtcactctcctgttctctgagccattgctcagggccagccaagatattattgagaacagataatttaccttggagccagaggccctccctgcctttagcaaggatgttcagggacagacaaagagggcagtggtggtgaatgttgttactgccatgaggagaaatggcagtaagaaatcttaactacaagcagccaatttctcattccaggaccctagccagaataattgacttctttttttttttgagacagagttttgcttttgttgccctggctggagtgcagtggcgcaatcttggctcaccgcaacctccacttcccaggttcaagcaattctgcctcagcctcccgagtagctgggattacaggcatgcgccaccacgcctggctaattttgtatttttagtagagacggggtttctccatgttggtcaggctggtctcgaactcccaacgtcaggtgatcctcccgcctcagtctcccaaagtgctgggattacaggtgtgagccaccatgcctggtctagggaattgacttctttttgaccttctgcactcccttccccaaaaggattgtggcttctgttgaccattgacctcagcagaagttgataaggcaggaggtttccagtcctcctggaaaaccaactgctgagcatgagttgtccttggctgtctctgggcctcgcacccatgggaagttttgaggtagggcccttgctgtttacaacttctgagagagtagtgatgggaccccaaagtaagcttgtatcagagggcagtaatgaccttcccatatccccatcctgtggtcacctgggatttgggttccctggggcggaagtgggaaataggagcccagggaaggacatctgaagcacccacagtttaaatagcgactcttcttggttagccagggctgtgctcatgttgggccctacccaggtcagtggccttttcactctcaaagatcgggggtgacgaagcagcatcttaaacagtgtttaggctgacagatttttccagttgaagaagctgaagtatctgccttttgagggtgactctagattacaagagagactatcagatccaatcagcttttgaaaaatcaggaatgtgcttaaaatgccagtgagtggttgtgaagatcaggtttatttcccaggataggcagtctttctttccctccttttccagttctcttttcctacctgtccttccataagcctggtctctagtgccgaggaccttggagaagagagggcccctagctaagctggagccagaaagaaccttcatggtgagtgtggtttcccaaacttgggaaatgaacctagggtgaggttagggaggatttgtagaattctagcaggtaaaaatcaagcctttttcccctcccatagtaaacttaaccattttcaccctgtacgttatcttctagctcctactaacatctccaattagacaaccgcttcaaagggtgcttagcaccagggattggggttcatggacttaggaggtggtaaggaaactggctggcaccaccaaactgccttagtgaacttggcccttcccaggcaggtaggttgggcattgagggaaggtggcccagtctttgctggcagggtctggccagtctcatgggggcaccaccagtttggtgacagaagtggtgtcatttattgaattccacctccgtttagaaggagatcatggtacaaagcccaggaggggccttaagatgtgaagatctctctgagtaaaaggcaaggggcttctcttcttcacctctgggatagttggtagatcggagagttttattttcagggtcaaggctgtggactgatggggatattggagggtgggtgggttttcctgagagactttgtataatgctgaatgtgtccagagggacaagtttgcagaacctcatattggtatattaaagaaataataaaataaaaaagcactttaggttattttatctttaacccgattgctgcaatttcttttgtgtgtatatatacatatatatactttccacaaagttttattttttgctcagaataaaaagttaaattgaggtgtgaaaagaaaagcacttaccttggtgcaatatgtgtagcttgatggtcgttgtcccatgtggccctggcctggcagcgtttttccgctcaatcagccctgtgctgtgagactgtccatagggaaacactattatgcattctcagcaaccgctcaatctatgcaagccttccctgtgtgccccagggcgccccctcaggctctctgaagaactgctgtgggtcctgttttctgctgactgttgaggccctttttcatcacttcttggtctctcgccatcttttccctcttcaccattacaaaatgatgcctgaaaggaaggaacagattgttcctaggtagaaacctggcaccttctagacttttatatttgtaatcacatccattgtccttaaagacttttccagagtgattgaaaccattgatttgtggaactgcaacaatatttctcaagagtttacaattgtcttacaccaccaatcagaaatatgtttggggaggcatgggtggcagggggcaacatgagccatttccatactgctccccatactacctgtgttggttccttaagcaaaaaggcctccagccttcattaaatcctataaacaaacattacatcccatgaatcattatcaactttcttcctttactccacctcccccattttatcttcaattctcaggctatagaatagacaagttttagaatatacttcagccaaagcagaaggattttcatagatccaatatgcaaatagttctgctgtgacatagatcagaaattgtctgttccttaatatttgggggtggaggcaacaaaactgaagcatatttctgattggttagccattttggcctgtttcctcttgcatgttttttagggagagagggaaacagtcctgtatttcttctgatgccctttggggaagccgacgaccactgggcatttctcactgttactcctgttcaagagagggcttctcagtctgcactgaaaaatgcaaattaaactggatctttatgtcaatgtgtacatagtacaagcttttttactggaattgaggtttaaaaccacacactgcccttttggtggtgtgcctgttgggccaaaaattgggtgataatgtagtgtcactttctcagctcaatgcagtttctactttttcttatgggaaaatttttcataaaacctttttgcaccaaaacccaggggtgttttttgcaatatccttgttatcctcgtagtgtgccaagtcagaggctttctcttgcccttttcctgctgtgttctcaggcctcccaagggctatttgactcaacagtctacatccttcgttgtgttttggagaatgtgggggtgggggtcagagttcaaggtgtctgttcccttttcctgtgaactctttctagtccctatttggggagggtggctggaaacagatttttgctgaatttctggctcagatcttctagccaggaaaggcaagagcccccaagagcccttttttttgacatacactaatcattggccggggtcttggtgacaacttttaaaatcccaaatagttttatttggattatgtaaaagtaagtgtgaaacatgggaacaacggacttccactgagcgatgtgaaaacgttacaggttcagtacttccaaaggaagaaacctccaaacccaaaaaagaataaatatgaatttgtatttttgaagaatgtgaaataatggtgtttgcttaattgctcattttgtataaacttaatattgtactttaaaatatctgctaaaaagtgaaaatttaactttttggaattgaaaaagcaatattaaatactaatgaaatcctaattaaatgcttatttaaatctggta

SEQ ID NO: 153125 - DNA, 2876 bp, Homo sapiens
  Payload ID: 10129
  Gene Symbol: MTA1
  Gene Name: metastasis associated 1
  Uniprot ID: Q13330
  ENST ID: ENST00000331320
  CDS Start-End: 215-2362
tcctcctcttcctctcccgcccgcgccgcggccctcccgtccctgcgcggcctcggcggcctcggcggcggcggcggcggcggcggcggcagcagcgcggcccctttaaacgcctgcggcgccccccgcccccgccatcgcgcctccattttcccggccgcccgcgccgagcgccgcgcccgccccgggcccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaacccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacaggccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaa

SEQ ID NO: 153126 - DNA, 2709 bp, Homo sapiens
  Payload ID: 10129
  Gene Symbol: MTA1
  Gene Name: metastasis associated 1
  Uniprot ID: Q13330
  ENST ID: ENST00000405646
  CDS Start-End: 99-2195
cggcgccccccgcccccgccatcgcgcctccattttcccggccgcccgcgccgagcgccgcgcccgccccgggcccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaagggaaatagaagaggaaatggagaacccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacaggccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaa

SEQ ID NO: 153127 - DNA, 2770 bp, Homo sapiens
  Payload ID: 10129
  Gene Symbol: MTA1
  Gene Name: metastasis associated 1
  ENST ID: ENST00000406191
  CDS Start-End: 145-2256
gcggcggcggcggcggcggcagcagcgcggcccctttaaacgcctgcggcgccccccgcccccgccatcgcgcctccattttcccggccgcccgcgccgagcgccgcgcccgccccgggcccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaacccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggtctggcaaaccacggacaggccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaa

SEQ ID NO: 153128 - DNA, 2888 bp, Homo sapiens
  Payload ID: 10129
  Gene Symbol: MTA1
  Gene Name: metastasis associated 1
  ENST ID: ENST00000435036
  CDS Start-End: 1609-2376
gctcctcctcttcctctcccgcccgcgccgcggccctcccgtccctgcgcggcctcggcggcctcggcggcggcggcggcggcggcggcggcagcagcgcggcccctttaaacgcctgcggcgccccccgcccccgccatcgcgcctccattttcccggccgcccgcgccgagcgccgcgcccgccccgggcccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaacccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggcacttacctgggtctggcaaaccacggacaggccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaacc

SEQ ID NO: 153129 - DNA, 2144 bp, Homo sapiens
  Payload ID: 10129
  Gene Symbol: MTA1
  Gene Name: metastasis associated 1
  Uniprot ID: Q13330
  ENST ID: ENST00000438610
  CDS Start-End: 21-1313
ccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaacccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacatgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacaggccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgc

SEQ ID NO: 153130 - DNA, 2050 bp, Homo sapiens
  Payload ID: 10129
  Gene Symbol: MTA1
  Gene Name: metastasis associated 1
  ENST ID: ENST00000434050
  CDS Start-End: 1-1536
cagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggcacttacctgggtctggcaaaccacggacaggccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaa

SEQ ID NO: 153131 - DNA, 904 bp, Homo sapiens
  Payload ID: 10129
  Gene Symbol: MTA1
  Gene Name: metastasis associated 1
  ENST ID: ENST00000424723
  CDS Start-End: 1-166
ccggagaatcgaggagctcaacaagacggccaatgggaacgtggaggccaaagtggtgtgcttctaccggaggcgggacatctccagcaccctcatcgccctggccgacaagcacgcaatgggcgggggtgtcctggctccgtttcctcgggggctgggtgaatgaagtcctcgcacgccccccggagtggtctgtctctcactggcatcctctgcaagcttgtcatggtgtggctgggtgtgggcatcattgatcgaggcttctttttcccttctatgatgacttctggagactttccaggctgccctgtcagtctgctataaggccggaccgggggcggacaacggcgaggaaggggaaatagaagaggaaatggagaacccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctac

SEQ ID NO: 153132 - DNA, 461 bp, Homo sapiens
  Payload ID: 10129
  Gene Symbol: MTA1
  Gene Name: metastasis associated 1
  ENST ID: ENST00000551236
  CDS Start-End: 1-173
ccgccgccggcccggacatggccgccaacatgtacagggtcggagactacgtctactttgagaactcctccagcaacccatacctgatccggagaatcgaggagctcaacaagccctgtcagtctgctataaggccggaccgggggcggacaacggcgaggaaggggaaatagaagaggaaatggagaacccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgact

SEQ ID NO: 153133 - DNA, 3058 bp, Homo sapiens
  Payload ID: 10130
  Gene Symbol: MTA2
  Gene Name: metastasis associated 1 family, member 2
  Uniprot ID: O94776
  ENST ID: ENST00000278823
  CDS Start-End: 391-2397
cgaaggtgttccggaaggaggcgaaccctgaggcgggcccggcaagccttccctgcggccggcagagcccaacgactagtgggactccgcgggggcgggggtagctggagcctggctctggcctggcaggagccgagctcgttccggaagaagccgagcggacgggggccagcctcagcgtcccgggagtgaggcgatagctgcggcggcgacagcgcgggccgggatgaaccgcgacggctgaggcagcggaggtgccggctgcgcgggccccagtgagactccctcgaagcggcagcccaccgttcggggctttgcctcgagccgagccctgcccccgcgagcctcccggacccctttgtgcggccggaggcggcggcgggaacggccatggcggccaacatgtaccgggtgggagattacgtctattttgagaactcttccagcaatccttacctggttagacggattgaggagctcaacaagactgcaaatggaaatgtggaggcaaaggttgtctgtcttttccggcgcagggacatttctagtagcctcaacagcctggctgatagtaatgccagggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggggaggggaagagtaaacagataacaggtggtggtacctggttgggggaggggggcgtgcactgccatgtctttttttttttttttttttttttttttcctaattgggggtttctctttctgtccggtgtccggactttcctaattggagtttgaggcccctaagctggcatcaaccccaggccacgctcgctctttccttccctcccctccccctctgccttttgtacgccagttctcagaaataaagatcttttgtccgtttttttaacctcggattctgtaattggttcttatagtaacaaataaaaagctgttttcttca

SEQ ID NO: 153134 - DNA, 2577 bp, Homo sapiens
  Payload ID: 10130
  Gene Symbol: MTA2
  Gene Name: metastasis associated 1 family, member 2
  Uniprot ID: O94776
  ENST ID: ENST00000524902
  CDS Start-End: 430-1917
gcacaaccccccccttctccctgaggttgggaacaatacaccaatgagcctggggctgaggttcttctgctccctcccactttggttggcgcctagccaggggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggggaggggaagagtaaacagataacaggtggtggtacctggttgggggaggggggcgtgcactgccatgtctttttttttttttttttttttttttttcctaattgggggtttctctttctgtccggtgtccggactttcctaattggagtttgaggcccctaagctggcatcaaccccaggccacgctcgctctttccttccctcccctccccctctgccttttgtacgccagttctcagaaataaagatcttttgtccgtttttttaacctcggattctgtaattggttcttatagtaacaaataaaaagctgttttcttc

SEQ ID NO: 153135 - DNA, 2265 bp, Homo sapiens
  Payload ID: 10130
  Gene Symbol: MTA2
  Gene Name: metastasis associated 1 family, member 2
  Uniprot ID: O94776
  ENST ID: ENST00000527204
  CDS Start-End: 745-2232
gagagggtgcggggaaccgcgacgcggcagggctccgagactcccagagagaagctgcgggcagccccgacggcactttcggggctgcgtcaggggctccccggggcacggagtggccttcggaaccggttccgaaggagctgacagggtagggagggaacgcgaggggctggggcgacggctttgccaccgcgggggagccgcccggaggtttcctcttcccaggcgttattgtgcgcctcgattcgaaaagattacgtctattttgagaactcttccagcaatccttacctggttagacggattgaggagctcaacaagactgcaaatggaaatgtggaggcaaaggttgtctgtcttttccggcgcagggacatttctagtagcctcaacagcctggctgatagtaatgccagggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggt

SEQ ID NO: 153136 - DNA, 5832 bp, Homo sapiens
  Payload ID: 10131
  Gene Symbol: MTA3
  Gene Name: metastasis associated 1 family, member 3
  ENST ID: ENST00000405592
  CDS Start-End: 671-2284
agcctcggtgccgcctgccagcccgcggagggaagcggtccccgacccggccccggcccccacgttctggggcgcgagtcctgagaaggcgcctaacgtgtagcgcgcctggaccctctcgagatgctgcccttagagtgggatgaaagtctggggaggaacgccttgtcaccggcaaaaacagcctttctcttggtcttcgtctgcatcctccttttcaaaatatcttgatttcccccgcgcacccctgacccggctgcagcaccggccctccgagcgggaagagccccgtgaaggctccgcagagcgatctaccccgcgctcttgtccgtgcccagaaagcgggttccacttggcagggattattttaaactgctaccagcaattcattcacctgacacccgacaccggcagcccagcccgccggaggcgagacaggattgtccggtgcccgctagaggtcgccaaacggagtccttttgcgctggttcttaagtggattcctagtgaaaaggcagacaactgaaaatattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggctatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaattttg

SEQ ID NO: 153137 - DNA, 5484 bp, Homo sapiens
  Payload ID: 10131
  Gene Symbol: MTA3
  Gene Name: metastasis associated 1 family, member 3
  ENST ID: ENST00000406652
  CDS Start-End: 323-1936
tggcgaggcgggaagcacccggaatcttcctggccctagagcctgcaggctccaggccggccccttgaatctcaccgcgaggaaggcaccctgctgcctgcacttatttgcatccaagagtttgcattgagactggcgcttgcctactagggcagccacaggggggttccccagggacagagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggctatctccccctctggctcagtcatcgcctgcccacccttcacttcttaaaggtgcgcaagagaggagggccgactggagggtgtcgccggaaggtttcagcctgcccttcacaattccccttgtgcacagcccagtttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaattttg

SEQ ID NO: 153138 - DNA, 2202 bp, Homo sapiens
  Payload ID: 10131
  Gene Symbol: MTA3
  Gene Name: metastasis associated 1 family, member 3
  Uniprot ID: Q9BTC8
  ENST ID: ENST00000407270
  CDS Start-End: 230-1777
cccactcggccttgctagcctggcgctgggggcgggcaccagcccccacccctcggcgtaccatcccctttacttcccccaccccctgtcccctcccttccctcccttcccccccgtggcgaggcagcagcgacggcggcggcggcagcggcggtcgcggctgaggctgaggaggaggcggcggcggcgggcggggctcggctcgggctccgcgggcgggcgggcggacatggcggccaacatgtaccgggtcggagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaaccttatatgttgtgcttctgaccattttctcttttcctctctttccttttttttttgtttgtttgtttgcaataaacataagttcttgtgtacagccttttatttggtttattttttaacattgtttttgtgtgctgccatttgtatcatgccaacctggaaaaaaaaaatcaaaacattgaaacttctgtactctttaccagagagtagtgcttagcaaaagattggtgggaggtgatcctattccatggggttttgtgatggaattgcctgcagagcccttattgaagcacttttaccttttaggtagtgccacaatgtaacccctaaggatgctgttataatgagactccataatcgagacagtacagtccagtcttacatggattcattaggtttaaataaaatttgccaatttacactaa

SEQ ID NO: 153139 - DNA, 2041 bp, Homo sapiens
  Payload ID: 10131
  Gene Symbol: MTA3
  Gene Name: metastasis associated 1 family, member 3
  ENST ID: ENST00000406911
  CDS Start-End: 72-1616
ggctgaggctgaggaggaggcggcggcggcgggcggggctcggctcgggctccgcgggcgggcgggcggacatggcggccaacatgtaccgggtcggagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaaccttatatgttgtgcttctgaccattttctcttttcctctctttccttttttttttgtttgtttgtttgcaataaacataagttcttgtgtacagccttttatttggtttattttttaacattgtttttgtgtgctgccatttgtatcatgccaacctggaaaaaaaaaatcaaaacattgaaacttctgtactctttaccagagagtagtgcttagcaaaagattggtgggaggtgatcctattccatggggttttgtgatggaattgcctgcagagcccttattgaagcacttttaccttttaggtagtgccacaatgtaacccctaaggatgctgttataatgagactccataatcgagacagtacagtccagtcttacatggattcattaggtttaaataaaatttgccaatttacactaa

SEQ ID NO: 153140 - DNA, 1785 bp, Homo sapiens
  Payload ID: 10131
  Gene Symbol: MTA3
  Gene Name: metastasis associated 1 family, member 3
  Uniprot ID: Q9BTC8
  ENST ID: ENST00000405094
  CDS Start-End: 1-1785
atggcggccaacatgtaccgggtcggagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactga

SEQ ID NO: 153141 - DNA, 2525 bp, Homo sapiens
  Payload ID: 10131
  Gene Symbol: MTA3
  Gene Name: metastasis associated 1 family, member 3
  ENST ID: ENST00000409019
  CDS Start-End: 9-1781
gggcggacatggcggccaacatgtaccgggtcggagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaaaagctcatgaagtgaagacacagctctgctccatcctgcagcccttccttggcatgctctgaggctgtgaagaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagc

SEQ ID NO: 153142 - DNA, 706 bp, Homo sapiens
  Payload ID: 10131
  Gene Symbol: MTA3
  Gene Name: metastasis associated 1 family, member 3
  ENST ID: ENST00000433553
  CDS Start-End: 654-706
gtttgctctgctgcctgcctccttcccagtcttctgcggaagagagaaataaggtcaaacaaactttctccctactcacgacgccctcctccctctttcctggtaaaataataattcagataagtggcgtgtttgtatgagagactggctcttccttctctgctcattagccgagcttctgatggatggtggtgggaatggcctggctaaatgaggccactttgcagaagagagcggcgaaagagccactaagatagacaataacaatgcagctgcctttcggataaacacacagtgggaagtttccagcaagcctattagatgagaggaaaagccacacttgaaaaattttatccttttagttgaaagcctgcagcaatttcttaatcacaagacattaaatggatctggattaaatatggtaaaagggtaaaaaagatgctgatatcacccccagaacactttgcctcttagaagtgatcccccggcccccttttttcctcatcttcccagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagt

SEQ ID NO: 153143 - DNA, 1702 bp, Homo sapiens
  Payload ID: 10131
  Gene Symbol: MTA3
  Gene Name: metastasis associated 1 family, member 3
  ENST ID: ENST00000454356
  CDS Start-End: 72-1250
ggctgaggctgaggaggaggcggcggcggcgggcggggctcggctcgggctccgcgggcgggcgggcggacatggcggccaacatgtaccgggtcggagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaaccttatatgttgtgcttctgaccattttctcttttcctctctttccttttttttttgtttgtttgtttgcaataaacataagttcttgtgtaca

SEQ ID NO: 153144 - DNA, 758 bp, Homo sapiens
  Payload ID: 10131
  Gene Symbol: MTA3
  Gene Name: metastasis associated 1 family, member 3
  ENST ID: ENST00000430763
  CDS Start-End: 6-281
cggacatggcggccaacatgtaccgggtcggagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaagacggagtttcgctcttgttgcccaggctggagtgcaatggcacgatctcggctcactgcaacctccacctcccaaatcaagtgattctcctgcctcagcctcctgagtagctgggattacagaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccct

SEQ ID NO: 153145 - DNA, 2994 bp, Homo sapiens
  Payload ID: 10132
  Gene Symbol: MACC1
  Gene Name: metastasis associated in colon cancer 1
  Uniprot ID: Q6ZN28
  ENST ID: ENST00000332878
  CDS Start-End: 115-2673
atacggagcaaggcatgtttgaagagtacccgggtttggtagagtgacttctattcactaaaaccatgtgtctgaactgaagaagcttgggctcacttccacaaatgtggaaaaatgctaatcactgaaagaaaacattttcggtcaggaagaattgcacaaagtatgtctgaagcaaatttgattgacatggaagctggaaaactctcaaaaagttgcaatattacagaatgccaggacccagacttgcttcacaattggccggatgctttcacccttcgtggtaataatgcttccaaagttgcaaatccattctggaatcaactgtctgcttctaacccatttttggatgacataactcaactaagaaataacaggaagagaaataatatttccatcttaaaggaagatccttttcttttctgtagagaaatagaaaatggaaattcttttgattcctccggtgatgaacttgatgtgcatcagttacttaggcagacttcctcaagaaattctggaagatctaaaagtgtttcagaacttctggacattttagacgacacagcacatgcccatcagagtatacataactctgaccagatcctactacacgacttagagtggcttaaaaatgatcgggaggcttataaaatggcttggttaagtcaacgccagctggcccgctcctgccttgatttgaatacaattagtcagagccctggatgggcccagacacaacttgcggaggtcaccatagcttgcaaagtaaaccatcaaggagggtcagtacaattacctgaatcagacatcactgttcatgtgccccaaggtcatgtggctgtgggagaattccaagaggtgtctctaagggctttccttgatccgccacacatgcttaaccatgatctttcgtgcactgtgagcccgttgttggaaatcatgttaggcaacctcaatacaatggaagcccttttgctggagatgaaaattggggctgaagtaagaaaggatcctttcagccaagtcatgacagaaatggtgtgtttacacagcttgggtaaagaaggcccttttaaagttttaagcaactgctacatttataaagacaccatccaagtcaagctaatcgacttgagtcaggtaatgtatctagtggttgctgcacaagctaaagctcttccgtcaccagctgccaccatttgggattatatccacaaaaccacctcaattggaatttatggacccaaatatatccatcccagttttactgttgttttaacagtttgtggacacaattatatgccaggacagcttacaatttctgatattaagaagggtggaaaaaacatatctccagttgtgtttcagctctgggggaagcagtcatttttacttgacaagccacaagatttaagtatttctattttttcctgtgatcctgattttgaagtaaagacagaaggagaaaggaaagaaattaaacaaaagcagttggaagcaggtgaagtagttcatcaacaatttttattttctttagttgagcacagagagatgcacttgtttgatttttgtgttcaagtggagcctcccaatggtgaaccagttgcacagttctctatcactactcctgatccaaccccaaacctaaaaagactctcgaatctgccaggctatttgcagaagaaggaggaaatcaagtctgctcctttatcaccaaaaattcttgttaaatatcctacatttcaagataaaacattgaactttagcaactatggggtaaccctgaaggcagtgctaagacaaagcaagattgattacttccttgaatatttcaaaggggacacaatagctctcctcggggaaggtaaggtaaaagctattggtcagtccaaagtgaaagaatggtatgtaggagtcctcagaggtaagattggacttgtacactgcaaaaatgtcaaggtgatttcaaaggagcaagtaatgtttatgtcagatagtgtctttacaaccagaaatcttcttgaacagattgtcctgcctttaaaaaaattgacttatatctactcagttgtattaaccttggtgtcagaaaaagtttatgattggaaagttttagctgatgtcctgggttactcacatctgtccctggaagattttgatcaaattcaagcagacaaagaatcagagaaagtttcttatgttataaagaagttaaaggaagattgccacacagagagaaatacaaggaagtttctgtatgaacttattgtggctcttctgaaaatggattgccaagagttagtcgcacgtctcatccaagaagctgctgttctgacttcagctgtcaagcttggaaaaggctggagggaactagctgaaaagttagtacgactcacaaagcaacaaatggaggcatatgaaattcctcatcgaggaaacactggagatgttgctgttgagatgatgtggaaacctgcctatgattttctgtatacctggagtgctcactatggaaataactacagagatgtgttacaagaccttcagtcagctttggacagaatgaaaaaccctgtgactaaacactggagagaattaactggagttttaatactagtaaattctttggaggttttgagagtaactgcattctccacttctgaggaagtatagaaacaaagcgtgtgtttttgatgggagggaaaatgaggtaatggtgtgtgtgtgtgtgtgtctgtgtgtgtctgtgtgtgtctctgtgtgtctgtgtgtgtgtgtctgtgtgtgtgtgtctgtgtgtgtgtgtgtgtgtgtgtaggaaagaaagaatctcagaaaagcattatattaattttcttcatgctcaaaaccagtttttttttcctgatgaaagcacagcctaactgataaccaagatgggttttatcctcaaatatgtatttttgtgtatgtttcaaatacaagtattaggctgctttgttcttagaaaggaaa

SEQ ID NO: 153146 - DNA, 9159 bp, Homo sapiens
  Payload ID: 10132
  Gene Symbol: MACC1
  Gene Name: metastasis associated in colon cancer 1
  Uniprot ID: Q6ZN28
  ENST ID: ENST00000400331
  CDS Start-End: 310-2868
atgtttgaagagtacccgggtttggtagagtgacttctattcactaaaaccatgtgtctgaactgaagaagcttgggctcacttccacaaatgtagccttgtcagatgatatgcaaatgattcacatcagtgtttgaagttcaaaccaaggaaaactatcagaaaaggcttctgctttctttaaaaaataaaactacttgaaaagaaaaaaatcaagaattagaaagaagagtataacaataaagaaggaggggtcacaggtgaacgagatgtggtcaacacacacaaaggagaacaaaaagtggaaaaatgctaatcactgaaagaaaacattttcggtcaggaagaattgcacaaagtatgtctgaagcaaatttgattgacatggaagctggaaaactctcaaaaagttgcaatattacagaatgccaggacccagacttgcttcacaattggccggatgctttcacccttcgtggtaataatgcttccaaagttgcaaatccattctggaatcaactgtctgcttctaacccatttttggatgacataactcaactaagaaataacaggaagagaaataatatttccatcttaaaggaagatccttttcttttctgtagagaaatagaaaatggaaattcttttgattcctccggtgatgaacttgatgtgcatcagttacttaggcagacttcctcaagaaattctggaagatctaaaagtgtttcagaacttctggacattttagacgacacagcacatgcccatcagagtatacataactctgaccagatcctactacacgacttagagtggcttaaaaatgatcgggaggcttataaaatggcttggttaagtcaacgccagctggcccgctcctgccttgatttgaatacaattagtcagagccctggatgggcccagacacaacttgcggaggtcaccatagcttgcaaagtaaaccatcaaggagggtcagtacaattacctgaatcagacatcactgttcatgtgccccaaggtcatgtggctgtgggagaattccaagaggtgtctctaagggctttccttgatccgccacacatgcttaaccatgatctttcgtgcactgtgagcccgttgttggaaatcatgttaggcaacctcaatacaatggaagcccttttgctggagatgaaaattggggctgaagtaagaaaggatcctttcagccaagtcatgacagaaatggtgtgtttacacagcttgggtaaagaaggcccttttaaagttttaagcaactgctacatttataaagacaccatccaagtcaagctaatcgacttgagtcaggtaatgtatctagtggttgctgcacaagctaaagctcttccgtcaccagctgccaccatttgggattatatccacaaaaccacctcaattggaatttatggacccaaatatatccatcccagttttactgttgttttaacagtttgtggacacaattatatgccaggacagcttacaatttctgatattaagaagggtggaaaaaacatatctccagttgtgtttcagctctgggggaagcagtcatttttacttgacaagccacaagatttaagtatttctattttttcctgtgatcctgattttgaagtaaagacagaaggagaaaggaaagaaattaaacaaaagcagttggaagcaggtgaagtagttcatcaacaatttttattttctttagttgagcacagagagatgcacttgtttgatttttgtgttcaagtggagcctcccaatggtgaaccagttgcacagttctctatcactactcctgatccaaccccaaacctaaaaagactctcgaatctgccaggctatttgcagaagaaggaggaaatcaagtctgctcctttatcaccaaaaattcttgttaaatatcctacatttcaagataaaacattgaactttagcaactatggggtaaccctgaaggcagtgctaagacaaagcaagattgattacttccttgaatatttcaaaggggacacaatagctctcctcggggaaggtaaggtaaaagctattggtcagtccaaagtgaaagaatggtatgtaggagtcctcagaggtaagattggacttgtacactgcaaaaatgtcaaggtgatttcaaaggagcaagtaatgtttatgtcagatagtgtctttacaaccagaaatcttcttgaacagattgtcctgcctttaaaaaaattgacttatatctactcagttgtattaaccttggtgtcagaaaaagtttatgattggaaagttttagctgatgtcctgggttactcacatctgtccctggaagattttgatcaaattcaagcagacaaagaatcagagaaagtttcttatgttataaagaagttaaaggaagattgccacacagagagaaatacaaggaagtttctgtatgaacttattgtggctcttctgaaaatggattgccaagagttagtcgcacgtctcatccaagaagctgctgttctgacttcagctgtcaagcttggaaaaggctggagggaactagctgaaaagttagtacgactcacaaagcaacaaatggaggcatatgaaattcctcatcgaggaaacactggagatgttgctgttgagatgatgtggaaacctgcctatgattttctgtatacctggagtgctcactatggaaataactacagagatgtgttacaagaccttcagtcagctttggacagaatgaaaaaccctgtgactaaacactggagagaattaactggagttttaatactagtaaattctttggaggttttgagagtaactgcattctccacttctgaggaagtatagaaacaaagcgtgtgtttttgatgggagggaaaatgaggtaatggtgtgtgtgtgtgtgtgtctgtgtgtgtctgtgtgtgtctctgtgtgtctgtgtgtgtgtgtctgtgtgtgtgtgtctgtgtgtgtgtgtgtgtgtgtgtaggaaagaaagaatctcagaaaagcattatattaattttcttcatgctcaaaaccagtttttttttcctgatgaaagcacagcctaactgataaccaagatgggttttatcctcaaatatgtatttttgtgtatgtttcaaatacaagtattaggctgctttgttcttagaaaggaaagaaaaaagaaaagtgccctctctctctttcagtgttattttaaatttactaagtcaaagctgtttgaataattacatcacacagatatctgggtaaactagagactatcaacatgatcaaggcagtgttcccaggaggcagctagaaagaggggaagcaagcacacaccctgtggccagtcacggctgcccgctttccacacctgacctcttcagttcatcagtggggttcaccagcatcacccccatttttcatggggagaaactcagaagtggagagaacgtctgaggctacatagccagtacaaagtaggttttctgcttgaaaaacctgtttctatttctttttaaaaaatcatactgcataacagaatagtaaaaacaaaatgcgtgttaagacttacagggaaacagttgccgtttcattttaagtgagacttgctactctttttcatcgtctcttgaaagactgacagaaggaaaatatgacttatcagaaatctgttgtctgcatgcatggacctagtgttttcatcagctcccttcagcatcttgggacctctctaatcctgcctaatttgggactttttctgcaggattgtaatgtaaaatagttctttagctcttggagatttttaataatacgagttattaaaaaccaccaccaccagaaacttgattaacttgattaccctgttgagtagagaggtcttaaccaccgaaaacactgatatctttatgttggcatgctcatgcaaacacatgtgtgtgtgtgtgtgtgtgtgtgtgtgtgtgtgtgtaccacagtgttttataaagcacagcctaattgattatataggacaaaaattgtataggaccctgggtcagtataaatgctaatggctgacaaagttcacaaagagatgtattttgcttactcctctgttcaatcctctggttgcctgccagtgtttatgtgtgtatttggacagacattcatttattgtcattcagtcaataggtagagtatatgtgtctattttttggcaggcatatagatgcttgaggctaatgggaaaaaaccagcatgaactctgactttagtagtgctaagtaatagataattttaaaaaatgacaccgttaaatagaaaatggcatgcatactaacagttgcaatggagaggctgtgatgctacgagatataaacgtagagatgccatcatgtgaaactggaagtgggggtgggtcagggaaatttgttcttggaaagaaataatgaacctcaaggaagagtaggcattgtcctggtgtggtggggtgtaagcggtgatcccacaaagcactgaagctcttagatgggtgggagctgaataggtgcagatagcaggggtgaaggagtgaaaggataaaagattcaaggttgagatgaggatggagcaagaagaagccacattagggccattaaggctgctagaatttagaaagaaaacacacagcctcaaagaaatgtgggtaagccaaagaaggattttgttttgggaacctgaataaaagatgtccatttggctaaaaagtaaaagcagaatctttttagggcttttaatatacccaccctgggatatttggtatgctggcaatggtaattcaaattggcgtttaagaataatcttggccgggcgcgatggctcatgcctgaaatcccagcactttgggaggccgaggcgggcagatcactaggtcaggagatcgagaccatcctggctaacgcggtgaaaccccgtctctactaaaaatacaaaaaattagccgggcgtggtggcaggcgcctgtagtcccagctactcaggaggctgaggcaggagaatggcgtgaacccgggaggcggagcttgcagtgagccgagttcatgccactgcactccagcctgggtgacaggctgtctcaaaaaaaaaaaaaggaataatctgtacggctttcagtatttatatttgattataagggaacacagcctgaccaaataattatgtatacacattcaaggacagaatttattttaattaaaaataaattatgagagaaggaaaaaaaagcacagtttttactttcagaacacagtccttttttgtggtgattttgctttctttagaacattcttggaatcttattaacatgtcagctaaccagagaattttgggaagggatagtggggattaataactgggtttttccaggctccaagatctaagaagacagagatcttgttagctgattagtgtagtaagattaaataaataatttaaggtttacattgcatcatgtattatgattgtgattgagaataataagagtttaaaaaaatgaaaaacaagatctctgtaatttgaggatgaaacaatggttctaatattaatacacacaaatatattttataatcttgtaacaaatccttccaggggaaattttttttttttttttttttttttttttttgagccagagtctggctctgttgcccagactggagtgcggtgtttcaatcttgactcactgcaacctccacctcctgggttcaaaagatccttctgcctccgcctcccaagtagctgggattacaggcatgcaccaccttgtccgggtaatttttgtatttttagtggagacaaggttttaccattttggccagactggtctggaactcctgacctcaggtcatccacctgcctcggcctcccagagtgctaggattacaggcatgagccactgctcccagccttccagaggaattttaagcccatgtccaaacattctgtttgtataaatatattctaatttttaaataaatagtttctacttttctgaactttatattttttcttgctataatggattttcataatcagaaaagattaaattagtaatcatgaattgccttcaatatttggcagtaagtcaatgaaataataaggcacttatataccatctttgacatcattaaaagtatcaaatcccattaatctaaaacttctttaagcattttgaaagcagaaaatgtttacatggttctttcagttcctcaggctttttgtctaatgatgcgtgacttaggataagatttgaattaagtgcccagcttgaaacataataatttttctgtataagccacagatcctctacctcctttgtgttaaagcctttatatgaaacaattaagtagaagcattcaatagtgtgtcattaactgttcatactaataaatggatacagcacattttcatggcctgtaatgtagaacatactatataaagttctcagtttggggatgactaggtttctggaaggaatagaatgctaaatcaatggatggcattgggctgagaaacactgctgctactaatcagccttgaatgtgtaatgtgaacatgcaaaagagaacatgcatacactcaaatttgtacaatgctataactggaagttgaaggacttgaatttttatattgtgctattgttatgttttctgtaattgtttatatctaaggaatttttgaggtaatataaaagaaaaagagaataatgaacaatgatgtcactggagggtttttacattaaattagatcatttttcttcttattcacaataataatcttaatctttaagaattaattataatttaatattataattcataatctttaagaattaataattataatttaatattataattaataatctttaagaattaataatataatttaatattataattaataatctttaagaattaataattacaattaataattaataataatcttaatctttaagaattaataataatccttaatcgcaataataatcgcaaggaggagaagtaagtccctcctccttctgtatgaacttttctcccacatgctgctgtatggtttagtgagagtgaagttctaaagaacatcaatatgattggtgggataatccaaagacattttttcagaatcaaatggcatgtcgaaggtttgtttcttgcatatgtatttactggtccacagcacaaaataaagtgaccacatatacataggaaagttgaatttgtacacatacagcatctgaaatgtatctgatgttcagcatcaagatttcactgaacattgtagaaatgtgtatcttttgcatgtatattttacattgattttctatttatgtacatctagaaagttttaaccctaataaatagttttgtaattttgaataatagtgtcagtttatatgtgagggagtagagacagagaggttagcactggataataattagtaaggccaaaggagaaaatttcatagaaaatattgttgttgtcataatgagtacagcatgaaaggcttcctctacaagacactagtcaaagagttgagagctgcggtttctaatctttgtccattactcccttactccctatgagactgtggacctgtcacttggcctctctggtcttcagttttctcaccagtaaaacaaggaacttgaaccaaatgacctctagtgttccccttgggtttaaatgtctataaatgttcaatgactagaatgtattgcgtttttctttattctttttgctttgagaaaagagaatgtgatttaagagtaataatttgaataccaattatccacattaaaattgtgtcctctatgtgtaaggcatagcacatttagcacacatacataagcacactaagcaccttacaaatatcctcatttattctttacataatcttttgaaattgattatgtaatacacactgtttttgaacaattggtgacttccagctgtttaaaacaaactacagtatggtgcttgagtactgacttaggaggtcagcattggtttcactaggagcttctcaaagcacgctgccaaacatgctccagtctcattgtcaaggccttagaccaggcaatcattacggcagtggttcttcaacttcagcagcagcaaaacgatctggcgggggcttggtgaaacagactgctgggctcgaccaccagaatttctcattcagagggtctggcctgatcacttgcatttctaatcacttcccaggtgatgcagatgtttctggtccagggaccccagtttgagaaccactgtattaaaatttccttcatctctatagaaatggaaagattttttataagtcctctaatttgctttaagataaatgagatttcacttaattctgttggagaaattgttttaaaaattgtgctaaagaaccgaaaatcactttatgttaaggctctatttatagcaagtgaacttttcatgagttaataaaggcctacaaaaataattttgactgtgaaactaattaaaatctctgtgtttcatttaaagcataaacatatttgaataaaaataggttaacaataatttgggacatgtattcagtataattttaagataattttacaaaatatatgtaacattgcatttgtttctgtaaaatatcttcggaaaaagccttgttttccctagtgtgttatttgttgaatttcttgttaaatgtattttttcccattgaaaaaaatgtttttaatcaatgtgatcaatacagctatctatatgccctgctttcactgtagaattagaaagtgttaataaggtgatcggatgttctttctaaggatcatattccacatttaaagagatggtgactgagaagaggtggcaagctgaaccatctcactttgagattgacgtatcacgttttatcctctgccatcatttccttgttaattgtttttctttgggtgattggaagaatctatggcttccttttctctgttcttaaagatatcaagactctgcccttttgtgactggaagtagattttaaatgtccctaatgtttatatgctcacttaaactcaatacatggaatttactggggcatttaacttgttcatgaaaatagagtgagtcattgaaaaatcaaa

SEQ ID NO: 153147 - DNA, 2686 bp, Homo sapiens
  Payload ID: 10132
  Gene Symbol: MACC1
  Gene Name: metastasis associated in colon cancer 1
  Uniprot ID: Q6ZN28
  ENST ID: ENST00000589011
  CDS Start-End: 99-2657
gagattgaaaagtaatggcgtgtgttctaccctcacgattaaaaaggaaaagttctctgtgaatcataatcaaagaatctttgacctgaagtggaaaaatgctaatcactgaaagaaaacattttcggtcaggaagaattgcacaaagtatgtctgaagcaaatttgattgacatggaagctggaaaactctcaaaaagttgcaatattacagaatgccaggacccagacttgcttcacaattggccggatgctttcacccttcgtggtaataatgcttccaaagttgcaaatccattctggaatcaactgtctgcttctaacccatttttggatgacataactcaactaagaaataacaggaagagaaataatatttccatcttaaaggaagatccttttcttttctgtagagaaatagaaaatggaaattcttttgattcctccggtgatgaacttgatgtgcatcagttacttaggcagacttcctcaagaaattctggaagatctaaaagtgtttcagaacttctggacattttagacgacacagcacatgcccatcagagtatacataactctgaccagatcctactacacgacttagagtggcttaaaaatgatcgggaggcttataaaatggcttggttaagtcaacgccagctggcccgctcctgccttgatttgaatacaattagtcagagccctggatgggcccagacacaacttgcggaggtcaccatagcttgcaaagtaaaccatcaaggagggtcagtacaattacctgaatcagacatcactgttcatgtgccccaaggtcatgtggctgtgggagaattccaagaggtgtctctaagggctttccttgatccgccacacatgcttaaccatgatctttcgtgcactgtgagcccgttgttggaaatcatgttaggcaacctcaatacaatggaagcccttttgctggagatgaaaattggggctgaagtaagaaaggatcctttcagccaagtcatgacagaaatggtgtgtttacacagcttgggtaaagaaggcccttttaaagttttaagcaactgctacatttataaagacaccatccaagtcaagctaatcgacttgagtcaggtaatgtatctagtggttgctgcacaagctaaagctcttccgtcaccagctgccaccatttgggattatatccacaaaaccacctcaattggaatttatggacccaaatatatccatcccagttttactgttgttttaacagtttgtggacacaattatatgccaggacagcttacaatttctgatattaagaagggtggaaaaaacatatctccagttgtgtttcagctctgggggaagcagtcatttttacttgacaagccacaagatttaagtatttctattttttcctgtgatcctgattttgaagtaaagacagaaggagaaaggaaagaaattaaacaaaagcagttggaagcaggtgaagtagttcatcaacaatttttattttctttagttgagcacagagagatgcacttgtttgatttttgtgttcaagtggagcctcccaatggtgaaccagttgcacagttctctatcactactcctgatccaaccccaaacctaaaaagactctcgaatctgccaggctatttgcagaagaaggaggaaatcaagtctgctcctttatcaccaaaaattcttgttaaatatcctacatttcaagataaaacattgaactttagcaactatggggtaaccctgaaggcagtgctaagacaaagcaagattgattacttccttgaatatttcaaaggggacacaatagctctcctcggggaaggtaaggtaaaagctattggtcagtccaaagtgaaagaatggtatgtaggagtcctcagaggtaagattggacttgtacactgcaaaaatgtcaaggtgatttcaaaggagcaagtaatgtttatgtcagatagtgtctttacaaccagaaatcttcttgaacagattgtcctgcctttaaaaaaattgacttatatctactcagttgtattaaccttggtgtcagaaaaagtttatgattggaaagttttagctgatgtcctgggttactcacatctgtccctggaagattttgatcaaattcaagcagacaaagaatcagagaaagtttcttatgttataaagaagttaaaggaagattgccacacagagagaaatacaaggaagtttctgtatgaacttattgtggctcttctgaaaatggattgccaagagttagtcgcacgtctcatccaagaagctgctgttctgacttcagctgtcaagcttggaaaaggctggagggaactagctgaaaagttagtacgactcacaaagcaacaaatggaggcatatgaaattcctcatcgaggaaacactggagatgttgctgttgagatgatgtggaaacctgcctatgattttctgtatacctggagtgctcactatggaaataactacagagatgtgttacaagaccttcagtcagctttggacagaatgaaaaaccctgtgactaaacactggagagaattaactggagttttaatactagtaaattctttggaggttttgagagtaactgcattctccacttctgaggaagtatagaaacaaagcgtgtgtttttgatgggaggg

SEQ ID NO: 153148 - DNA, 2777 bp, Homo sapiens
  Payload ID: 10133
  Gene Symbol: MTSS1
  Gene Name: metastasis suppressor 1
  Uniprot ID: O43312
  ENST ID: ENST00000325064
  CDS Start-End: 319-2598
caagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagtggacactcttgggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataa

SEQ ID NO: 153149 - DNA, 4458 bp, Homo sapiens
  Payload ID: 10133
  Gene Symbol: MTSS1
  Gene Name: metastasis suppressor 1
  Uniprot ID: O43312
  ENST ID: ENST00000378017
  CDS Start-End: 64-2256
cccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagaactcgtccagctcggcctcctccgaagcctcggaaacctgccagtcagtgagcgagtgcagctcccccacctctgtcagctcgggctccaccatgggtgcctgggtgtccacagagaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagatt

SEQ ID NO: 153150 - DNA, 1711 bp, Homo sapiens
  Payload ID: 10133
  Gene Symbol: MTSS1
  Gene Name: metastasis suppressor 1
  Uniprot ID: O43312
  ENST ID: ENST00000431961
  CDS Start-End: 186-1607
gttgtgttggcagaagagttggtgggggttgtgcagtgtgagaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaa

SEQ ID NO: 153151 - DNA, 788 bp, Homo sapiens
  Payload ID: 10133
  Gene Symbol: MTSS1
  Gene Name: metastasis suppressor 1
  ENST ID: ENST00000522118
  CDS Start-End: 166-788
ggtgggggttgtgcagtgtgagaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctag

SEQ ID NO: 153152 - DNA, 2166 bp, Homo sapiens
  Payload ID: 10133
  Gene Symbol: MTSS1
  Gene Name: metastasis suppressor 1
  ENST ID: ENST00000524090
  CDS Start-End: 139-2076
gtgagaaggcaagtcatgaagagttgccccaggacattttccttgtcaggaataagccaggctaaatgtgccctttgggcattgaaaattggaaatggctggtcctagaaaaacagctgccttaaatccttttggggcatgaataaatactttttttacatcctggaaaattgtggttttgactccagcaaggaccccagggaggaggggcacttgttccagaagctggtatttcagcaagccgtgcttgggtctctgttttttgcagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaa

SEQ ID NO: 153153 - DNA, 857 bp, Homo sapiens
  Payload ID: 10133
  Gene Symbol: MTSS1
  Gene Name: metastasis suppressor 1
  ENST ID: ENST00000523179
  CDS Start-End: 1-857
agggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcg

SEQ ID NO: 153154 - DNA, 1822 bp, Homo sapiens
  Payload ID: 10133
  Gene Symbol: MTSS1
  Gene Name: metastasis suppressor 1
  ENST ID: ENST00000519168
  CDS Start-End: 1-1630
ctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagaactcgtccagctcggcctcctccgaagcctcggaaacctgccagtcagtgagcgagtgcagctcccccacctctgtcagctcgggctccaccatgggtgcctgggtgtccacagagaagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatctttta

SEQ ID NO: 153155 - DNA, 4944 bp, Homo sapiens
  Payload ID: 10133
  Gene Symbol: MTSS1
  Gene Name: metastasis suppressor 1
  Uniprot ID: O43312
  ENST ID: ENST00000518547
  CDS Start-End: 475-2742
gcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagatt

SEQ ID NO: 153156 - DNA, 553 bp, Homo sapiens
  Payload ID: 10133
  Gene Symbol: MTSS1
  Gene Name: metastasis suppressor 1
  ENST ID: ENST00000522162
  CDS Start-End: 1-553
tttccctcgggggctcaaggcactggctgcaagttttcccattgtctgtccctgaagggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattga

SEQ ID NO: 153157 - DNA, 4992 bp, Homo sapiens
  Payload ID: 10134
  Gene Symbol: MTSS1L
  Gene Name: metastasis suppressor 1-like
  Uniprot ID: Q765P7
  ENST ID: ENST00000338779
  CDS Start-End: 276-2519
taccgccgccgtcagtccccgcgccgaggctgcgccgcgagctgcccgcgccgcgccccccgcgccgcccgccagccccgctgcgacatggcccgcgccgcccgccggaggcccgcgaccccggagcgcggcgcggccggccgctgagcgcagcctggaggcgggaggcccggcccggcctcggagcgagcgcccgcgcggcctggccccctcccttgcgctgctccccgcgctccgtgcgcctagccgccgccgcggcccggcccagccagagcatggagacggcggagaaggagtgcggcgccctgggcgggctcttccaggccatagtcaacgacatgaagagctcctaccctatctgggaggacttcaactccaaggccacgaagctgcattcccagctgaggaccaccgtgctggctgctgtggccttcctggatgccttccagaaagtggctgacatggctaccaacacccgaggggccacgagggacatcggctcggcgctcacacgcatgtgcatgcgccaccgcagcatcgagaccaagctgcggcagttcaccaacgcactgctggagagcctcatcaacccgctgcaggagcgcatcgaggactggaagaaggcggccaaccagctggacaaggaccacgcgaaagagtacaaacgagcccggcatgagatcaaaaagaagtcgtcggacacgctgaagctgcagaagaaggcgcgcaaagagctacttgggaaaggagacctgcagccccagctggacagtgccctgcaggacgtcaacgacatgtacctgctgctggaggagacggagaagcaggccgtgcgccgggcgctgatcgaggagcggggccgcttctgcaccttcatcaccttcctgcagcctgtggtgaatggagagctgaccatgctgggagagatcacccacctgcagggcatcatcgacgacttggtggtgctgacagcagaaccccacaaactgcctcccgccagcgagcaggtaatcaaagacctaaagggctcggactacagctggtcctaccagaccccaccctcatcacccagcagctccagctcccggaagtccagcatgtgcagtgcccccagcagcagtagcagtgccaagggtggcggagccccatggcctgggggtgcccaaacatactcacccagttccacctgtcgctaccgcagcctggcgcagccagccaccaccaccgctcgcctctccagcgtttcctcccatgactctggcttcgtctcccaggacgccacctactccaagcccccctcgcctatgccttcagacatcaccagccagaagtcctccagctctgcatcttccgaggcctcggaaacctgccagtccgttagcgagtgcagctcccccacctcggactggtccaaggtcggctcccatgagcagccctcaggcgccactctgcagcggaggaaggaccgagtggagctcctgcgagacacagagccaggccctgccagtgggggcaccctgggccccagcggggaagaggcaccgcgaccccggatgtcccctgccaccatcgcagccaagcacggtgaggaggtgtcccccgccgccagtgacctggccatggtgctgacgcggggcctgagcctggagcaccagaagagcagccgggactcgctgcagtactccagcggctacagcacgcagaccaccacgccctcctgctctgaggacaccatcccctcccaaggctccgactacgactgctactccgtgaatggggatgcggacagcgagggcccgcccgagtttgacaagtcatccaccatcccgcgcaacagcaacatcgcccagaactaccgccgcctgatccagaccaagcgcccagcctccactgctgggctgcccaccgcggggctgcccacggccactggcctgccctcgggcgcaccccccggcgtggccaccatccgccgcacaccctccaccaagcccaccgtgcgccgcgccctgtccagcgctggccccatccccatccggccgcccatcgtccctgtgaagacgcccacggtgcctgactcccccggctacatggggcccacacgggcgggcagtgaggagtgcgtcttctataccgacgagaccgcctcacccctggcaccggacctcgccaaggcctccccaaagaggctcagcctgcccaacacagcctggggcagcccatccccagaggcagccgggtaccccggggcaggggccgaggacgagcagcagcagctggcggccaaccggcacagcctggtggagaagctgggggagctggtggcgggtgcccacgcactgggtgagggccagttccccttccccactgctctgtcggccacccccacggaggagacgcccaccccacccccagccgccaccagcgaccccccggccgaagacatgctggtggccatccggcgtggggtccggctccgcaggaccgtcaccaacgacaggtcggcgccccgcatcttatgatggcgccaccctccccatcctctcaggccccagtgcgagcaggtggcctggtctgtgagccgcaggcactcagagcaaaggcccagccaggagagaggacagagccagggcagaggccatgccactttatggaaagacacctcacttggattccagcatttaaacaggaagtgacttcttagcaagcctggccaggacggagcctgcaggcctgggcctggttcggggtctgttttatgctcttcggtccctcctcttcctcctctggggccctgcctcttccctacccataagcaccagagccagggccgctgcccatgacagaggggccaggctggcctccctttcaccatcccggcctctcccagggctggtcctgcctcagctcctcctggaatgctggcccccctctcccctgcctgagccccctcctcccctcttgccttctctctgcctctcccaggcccctctccctccaggaggcggggcggctgtggaggggccaggtgcacgctgggctggatgtctgctgggggctgggggccagggcggcaggttggagttgggcggccaggccccccgtgtgggaagggagttccagggcccacgccaagtctcagggaggaaaccaggggctgcttgggggggggggtcttgggggccctgtggtggctcccacccctcgcctcccccaccccgtgaggctggctggagggggccagagcagctctttggaaactagggcagcagggttaggaggccggaggccctggggtcaccggccagccacacaggcaccgttttcagatgtccacttctcattgggtacatcaatcttttaactttgggggtcacagttttagccacctttcggggggtgactggagcagtaggaggtgtggggtcattttatgaatataataaaatggagctgactgtggacgaggactaagtgtgggggagaggggacgatacagggtgtgtgtctgggagtgcctgggggacagggaccccccggtggtcctatggcaggatgagaagggagggacttggctcccccagagcccggtggaagctactgttctctccagtgtctcgagcgtagccaaaataaggttgggaggctcccggcctgtctgctgtggtctgagctggctgcaagcccaggtgggggagcgagtctgggaagattggctttgactctctgttgccggaggagatgccatcccagcacggcccccactgtagtccaggctcgtggtggcagcgggggcaaggggaggggcaaggctgcccccaccccacgcaccaagtcacgccaagtctcagcaggtaaaagcacgtgagcctagggcgagcggagggagtcctggtggccccgcaggtcaggagggaaagcagggctcagagggcatcgtggccccagggcagggtcctacctgggggtcaggagcaccttggtcttgatgattgattgattgattgatagaatggagctgggtctgagcctcccaggcttgagctcctgggagttcttgtgcggtgagctgggcagctcctgggtaggtccgggcaccaagcaggccctgatgtggacagagtcccatcagagggagctgatgaagaatggtccctgtaagtaagtcactaggttcaacaactgcctggccgagcactcagcccgtggagctcaggccaacaccagagccccggttttaggggccaggagagcaggtgaccaattatttggggagtcttgggtagaatttccgccacacattctccccagggctgcaggggtcttccgaggcagggcggtggagcaggattcaggatgtggtgggaatagagtgaggggcagtgggtgggcagacctgggcgtcagaggtcctgatgggaaaggaggcaggggctacccagagaggggggctcgtgtggcacagcccccaccgactccgccgtccccctcccctgtgagccccgggggctgtacatactctactccatccccttgtccatccctgagaccacccccgccgcccttgcgtcgacttagcaaccacctcataggcccacccacctcgggatccgagccaaccatcccacatcacaaactttggtttgggggactttacgttcgtttaatttctcattttgtacggagaaatattcttttcaaaagcgtcttttgactgaagtaactttcctggtgctgttgttaactcgttcctttttttaatttattcccccaccccaggcagccctcctggttcctactcaccctccccccctcccccaccctccgtcccatctgaaccatttgtttcttttctttccgtcagattttggaaaaattctcctctcctccccgccccctccacaccatcctccccgatttaaatatagtcactgctacaagtaacagatgcactgtgaagattccagtattaataaaggtgtactgtaattaaca

SEQ ID NO: 153158 - DNA, 407 bp, Homo sapiens
  Payload ID: 10134
  Gene Symbol: MTSS1L
  Gene Name: metastasis suppressor 1-like
  ENST ID: ENST00000562883
  CDS Start-End: 1-407
ggagacggagaagcaggccgtgcgccgggcgctgatcgaggagcggggccgcttctgcaccttcatcaccttcctgcagcctgtggtgaatggagagctgaccatgctgggagagatcacccacctgcagggcatcatcgacgacttggtggtgctgacagcagaaccccacaaactgcctcccgccagcgagcaggtaatcaaagacctaaagggctcggactacagctggtcctaccagaccccaccctcatcacccagcagctccagctcccggaagtccagcatgtgcagcctggcgcagccagccaccaccaccgctcgcctctccagcgtttcctcccatgactctggcttcgtctcccaggacgccacctactccaagcccccctcgcctatgccttcag

SEQ ID NO: 153159 - DNA, 518 bp, Homo sapiens
  Payload ID: 10134
  Gene Symbol: MTSS1L
  Gene Name: metastasis suppressor 1-like
  ENST ID: ENST00000576338
  CDS Start-End: 1-518
cacgcatgtgcatgcgccaccgcagcatcgagaccaagctgcggcagttcaccaacgcactgctggagagcctcatcaacccgctgcaggagcgcatcgaggactggaagaaggcggccaaccagctggacaaggaccacgcgaaagagtacaaacgagcccggcatgagatcaaaaagaagtcgtcggacacgctgaagctgcagaagaaggcgcgcaaagggaaaggagacctgcagccccagctggacagtgccctgcaggacgtcaacgacatgtacctgctgctggaggagacggagaagcaggccgtgcgccgggcgctgatcgaggagcggggccgcttctgcaccttcatcaccttcctgcagcctgtggtgaatggagagctgaccatgctgggagagatcacccacctgcagggcatcatcgacgacttggtggtgctgacagcagaaccccacaaactgcctcccgccagcgagcaggtaatcaaagacctaaagggctcggactac

SEQ ID NO: 153160 - DNA, 2241 bp, Homo sapiens
  Payload ID: 10134
  Gene Symbol: MTSS1L
  Gene Name: metastasis suppressor 1-like
  ENST ID: ENST00000616026
  CDS Start-End: 1-2241
atggagacggcggagaaggagtgcggcgccctgggcgggctcttccaggccatagtcaacgacatgaagagctcctaccctatctgggaggacttcaactccaaggccacgaagctgcattcccagctgaggaccaccgtgctggctgctgtggccttcctggatgccttccagaaagtggctgacatggctaccaacacccgaggggccacgagggacatcggctcggcgctcacacgcatgtgcatgcgccaccgcagcatcgagaccaagctgcggcagttcaccaacgcactgctggagagcctcatcaacccgctgcaggagcgcatcgaggactggaagaaggcggccaaccagctggacaaggaccacgcgaaagagtacaaacgagcccggcatgagatcaaaaagaagtcgtcggacacgctgaagctgcagaagaggcgcgcaaaggtaccagggaaaggagacctgcagccccagctggacagtgccctgcaggacgtcaacgacatgtacctgctgctggaggagacggagaagcaggccgtgcgccgggcgctgatcgaggagcggggccgcttctgcaccttcatcaccttcctgcagcctgtggtgaatggagagctgaccatgctgggagagatcacccacctgcagggcatcatcgacgacttggtggtgctgacagcagaaccccacaaactgcctcccgccagcgagcaggtaatcaaagacctaaagggctcggactacagctggtcctaccagaccccaccctcatcacccagcagctccagctcccggaagtccagcatgtgcagtgcccccagcagcagtagcagtgccaagggtggcggagccccatggcctgggggtgcccaaacatactcacccagttccacctgtcgctaccgcagcctggcgcagccagccaccaccaccgctcgcctctccagcgtttcctcccatgactctggcttcgtctcccaggacgccacctactccaagcccccctcgcctatgccttcagacatcaccagccagaagtcctccagctctgcatcttccgaggcctcggaaacctgccagtccgttagcgagtgcagctcccccacctcggactggtccaaggtcggctcccatgagcagccctcaggcgccactctgcagcggaggaaggaccgagtggagctcctgcgagacacagagccaggccctgccagtgggggcaccctgggccccagcggggaagaggcaccgcgaccccggatgtcccctgccaccatcgcagccaagcacggtgaggaggtgtcccccgccgccagtgacctggccatggtgctgacgcggggcctgagcctggagcaccagaagagcagccgggactcgctgcagtactccagcggctacagcacgcagaccaccacgccctcctgctctgaggacaccatcccctcccaaggctccgactacgactgctactccgtgaatggggatgcggacagcgagggcccgcccgagtttgacaagtcatccaccatcccgcgcaacagcaacatcgcccagaactaccgccgcctgatccagaccaagcgcccagcctccactgctgggctgcccaccgcggggctgcccacggccactggcctgccctcgggcgcaccccccggcgtggccaccatccgccgcacaccctccaccaagcccaccgtgcgccgcgccctgtccagcgctggccccatccccatccggccgcccatcgtccctgtgaagacgcccacggtgcctgactcccccggctacatggggcccacacgggcgggcagtgaggagtgcgtcttctataccgacgagaccgcctcacccctggcaccggacctcgccaaggcctccccaaagaggctcagcctgcccaacacagcctggggcagcccatccccagaggcagccgggtaccccggggcaggggccgaggacgagcagcagcagctggcggccaaccggcacagcctggtggagaagctgggggagctggtggcgggtgcccacgcactgggtgagggccagttccccttccccactgctctgtcggccacccccacggaggagacgcccaccccacccccagccgccaccagcgaccccccggccgaagacatgctggtggccatccggcgtggggtccggctccgcaggaccgtcaccaacgacaggtcggcgccccgcatcttatga

SEQ ID NO: 153161 - DNA, 1589 bp, Homo sapiens
  Payload ID: 10135
  Gene Symbol:
  Gene Name: Metastasis-associated lung adenocarcinoma transcript 1  [Source:UniProtKB/Swiss-Prot
  Acc:Q9UHZ2]
  Uniprot ID: Q9UHZ2
  ENST ID: ENST00000625158
  CDS Start-End: 806-979
ctaataaaaatagtttattattttgaatgatttaatggttttctacacaatttacatcacaacatgtaaattttagcagtaacatctgattctaacagcacatcatgctattcctttcatagagccttcagagattcaatgctaaacaaatttccttagttggcatcaaggcactgatcactttagaggcttttaagaaattatttaaagatgcaaatgcctctgagtgaagtgtactatcccatcactgaagcccacaggaacaagtcctacaattttaaaaaggctcgatggaaaaatttctcaatcctgaaatcccctagggaaggggtcaggagaaagtgccatggttgatatttaagaactccacagctcttaaaaataagcacttatccctaacatgcaatactgcagatgcaagttaaacttatctgttaacagctgcctgctgttttctgctcccagatgaaatgaagcaactcttctgataacgaagagatacctgtctgaggcaaacgaaacattggcacacagcacagcctcctcaatccacttgatcccaactcatctctcatttatttcggcttcttttattccaggattaatgtagtgtaacattttcatttcttttcgcttttattctgcttttgtaaaagcagtattttgagatggacattgcctcttcattgtatttctcatcaattcattatttttgtggttatagcttgacaagcaattaactttaaaatggtagattccgtaactttaaattggtagctttcatttgcttaaaattttttggcatatgcagataatgttctcatcagtagtaagaatctcagggttatgcttattccccaatggaggtatgacatataatcttttctgcctttacttatcaattcaccaaggagctgttttctctgcatctaggccatcatactgccaggctggttatgactcagaagatgttatctgaaaaaagtctatagaaaaaaaaaaagtttcccctccctcatcaacaaaagcccaccctctaagagacattcaagctgaactatcacaattcttaatcagttacaatttacaaacagataagtttaaaataaacaatttacaaaatttttgaagcataccttaacatcttgttttgcagttaaacaatggaaaagtatttctcctacactaaaaaaaaacttgcttacacacaactgaaaatagaatcttacttgataatacaaaagctaccatcagaagaaatcccttcaggatcattaagccacttcctttgctctgcagtttctatagtagttttaaattattattaaatcacctgaaaaaaattccaaaagagaaccacacactaccatatccaaacaacttttgcatttcccataattgtagttaatgtcagcccagtaggccagaccaacccccagttcaatactttccttccccaaaagctctatactttgaaggaaaacagatacagtatcaaattatgacactttccttgcccaaattaatgcactggtacacccagtggctcatatttaacttcccccagcttcccaattcaaactgggggg

SEQ ID NO: 153162 - DNA, 1441 bp, Homo sapiens
  Payload ID: 10136
  Gene Symbol: MTX1
  Gene Name: metaxin 1
  ENST ID: ENST00000316721
  CDS Start-End: 9-1316
tggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgactctccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagaggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactga

SEQ ID NO: 153163 - DNA, 1632 bp, Homo sapiens
  Payload ID: 10136
  Gene Symbol: MTX1
  Gene Name: metaxin 1
  ENST ID: ENST00000368376
  CDS Start-End: 107-1507
aagccccagcccggcctccgctccggccgccgccaccgcccctgttttgtttccatggcgacaggcggcgcagggcccgctccaaacataacgcgctgtggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgactctccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagagaagtacaatgctgattatgatctgtcagctcggcaaggggcagacaccctggccttcatgtctctcctggaggagaagttgctcccggtgctggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactga

SEQ ID NO: 153164 - DNA, 946 bp, Homo sapiens
  Payload ID: 10136
  Gene Symbol: MTX1
  Gene Name: metaxin 1
  ENST ID: ENST00000424959
  CDS Start-End: 15-377
agagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggtacccagtatcccttgggggaactctgcctgcccttcggaccagtcatggagaggtcatctcagttccacacaagatcatcacccaccttcgaaaagagaagtacaatgctgattatgatctgtcagctcggcaaggggcagacaccctggccttcatgtctctcctggaggagaagttgctcccggtgctggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggc

SEQ ID NO: 153165 - DNA, 1085 bp, Homo sapiens
  Payload ID: 10136
  Gene Symbol: MTX1
  Gene Name: metaxin 1
  Uniprot ID: Q13505
  ENST ID: ENST00000609421
  CDS Start-End: 6-959
gcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagagaagtacaatgctgattatgatctgtcagctcggcaaggggcagacaccctggccttcatgtctctcctggaggagaagttgctcccggtgctggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactgac

SEQ ID NO: 153166 - DNA, 1364 bp, Homo sapiens
  Payload ID: 10137
  Gene Symbol: MTX2
  Gene Name: metaxin 2
  Uniprot ID: O75431
  ENST ID: ENST00000249442
  CDS Start-End: 212-1003
tgccgttgtcggctgcgccggaagtccctagccaggcctggcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcagctgcagaaccttggcctgaaaatgctacattatatcagcaattgaaaggggagcaaattttactttctgacaatgcagcttctcttgcagtgcaggcctttttgcaaatgtgtaacttgcctatcaaagtagtttgtagggcaaatgcagaatatatgtctccatctggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgtatggatgttacatttactttcttttgatttttctgaaagtcattcactgaattttacacatgtggaataaacagtgtcttttctaaggcaa

SEQ ID NO: 153167 - DNA, 817 bp, Homo sapiens
  Payload ID: 10137
  Gene Symbol: MTX2
  Gene Name: metaxin 2
  ENST ID: ENST00000452865
  CDS Start-End: 129-817
agtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcagctgcagaaccttggcctgaaaatgctacattatatcagcaattgaaaggggagcaaattttactttctgacaatgcagcttctcttgcagtgcaggcctttttgcaaatgtgtaacttgcctatcaaagtagtttgtagggcaaatgcagaatatatgtctccatctggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcacta

SEQ ID NO: 153168 - DNA, 618 bp, Homo sapiens
  Payload ID: 10137
  Gene Symbol: MTX2
  Gene Name: metaxin 2
  ENST ID: ENST00000423461
  CDS Start-End: 179-316
aggcctggcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcagctgcagaaccttggcctgaaaatgctacattatatcagcaattgaaaggggagcaaattttactttctgacaatgcagcttctcttgcagtgcagtgaatctattctttgaacattctacaacaagaattacattatactgttataccagagtacttctgcagtgtgaaatagattggtttggaaaatgaacctggctttgctataaattacattcacaggcctttttgcaaatgtgtaacttgcctatcaaagtagtttgtagggcaaatgcagaatatatgtctccatctggtaaagtaccttttattcatgtgggaaatcaagtagtatcagaacttggtccaatagtccaatttgttaaagccaagggccattctcttagtgatgggctggaggaa

SEQ ID NO: 153169 - DNA, 1592 bp, Homo sapiens
  Payload ID: 10137
  Gene Symbol: MTX2
  Gene Name: metaxin 2
  ENST ID: ENST00000420864
  CDS Start-End: 236-349
gcggggccggcggaagcgctcgagtgccgttgtcggctgcgccggaagtccctagccaggcctggcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcaggctggagtgcagtggcacaacctgggctcactgcaacctccgcttcccgggttcaagcgattctcctgccttagcctcccgagtagttgggattacaggcgcccgccaccacgcccgcgcggattcatggaaaatttttaaatctgcatgtactttaaagaaatacttttgagtcggtggactgaacatgactgatgtatatagctgcagaaccttggcctgaaaatgctacattatatcagcaattgaaaggggagcaaattttactttctgacaatgcagcttctcttgcagtgcaggcctttttgcaaatgtgtaacttgcctatcaaagtagtttgtagggcaaatgcagaatatatgtctccatctggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgtatggatgttacatttactttcttttgatttttctgaaagtcattcactgaattttacacatgtggaataaacagtgtcttttctaaggcaa

SEQ ID NO: 153170 - DNA, 799 bp, Homo sapiens
  Payload ID: 10137
  Gene Symbol: MTX2
  Gene Name: metaxin 2
  ENST ID: ENST00000443241
  CDS Start-End: 161-784
gggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcaggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtc

SEQ ID NO: 153171 - DNA, 1655 bp, Homo sapiens
  Payload ID: 10138
  Gene Symbol: MTX3
  Gene Name: metaxin 3
  Uniprot ID: Q5HYI7
  ENST ID: ENST00000509852
  CDS Start-End: 22-768
gtaaaggtcggcccgcgcaagatggcggcccccttggaactcagttgctggggaggcggctggggactcccatcggttcacagcgagtccctggtggtgatggcttatgccaaattttctggtgcacccttgaaagtcaatgtgatagataacacctggagaggttcaagaggcgatgtaccaattttgacaactgaagacgacatggtttctcagccagcaaaaatactaaactttttaagaaaacagaaatataatgctgattatgaactctcagcaaaacaaggggcagatacattggcttatattgctctcctcgaagagaagcttctccctgcagtgcttcacacattctgggttgagagtgacaattactttactgtgacaaagccatggtttgcttcacaaattccttttcctttgagtttgatcctgcctggaagaatgtctaagggagcactgaataggattctcctgaccagaggacagcctcccctctaccacctccgagaagtggaagcacagatatacagagatgccaaggagtgcctaaatcttctatcaaacagattgggaacatctcagtttttctttggagatacgccttctaccttggatgcctatgtttttggttttcttgcacctctttacaaagtacggtttcctaaagttcagctacaagaacatctgaaacagctctccaacctctgtcgcttttgtgatgacatcctgagcagttattttaggcttagtcttggagatggatgacaatcttcgccaaagccctcagcttcctcctcggaaactgccaacacttaaattgactccagcagaagaagaaaataattccttccaacggctttcgccctgagagtagtcatggtttgtggccaaagtcaaacgattgttgcagtaatctcttacaccaagtgtgtgaaggcaaaaagaagataccataataggtattaaggaagactctaaaccaaaaggaactttctatgccatctatttttactattattattaggaagcttgtattctagcttggcactgcatttttaataacaaagagaatgctaaatgaacttggttgggggggcggggaagaaaaacacatcgtactgtatacaaagaactgccttaatcatggcagatttttgcctttggttcacatgttgctgaccaaaggctacaattctgttctgaatgtgcactcctaatttatttgatttaatttattcaatttattaacttagttttcttagaccaggctgaatacctaatatgtggctttttggctgaggctttttacttctgtttagaaatttgatgcctattttaggaaccagaaaaagataaattgcttcagtagaagagaccatatttaactttaaaaagtgaggaggaatgtgctttttaattatgctctcataagtctaatcttttgggggtttagtagcacatagataaatattaaaggtggttacatataataacatctgataatactcatttcagtataacattggtctttgctgatgtgttcgatataggttaggaagagttcttttagtttacttgggcaaatgtggcagttttagacctatgtctttgtagtacatcttcagttgtctttcttgtattaattccagaag

SEQ ID NO: 153172 - DNA, 4799 bp, Homo sapiens
  Payload ID: 10138
  Gene Symbol: MTX3
  Gene Name: metaxin 3
  Uniprot ID: Q5HYI7
  ENST ID: ENST00000512560
  CDS Start-End: 121-876
gcgcaagatggcggcccccttggaactcagttgctggggaggcggctggggactcccatcggttcacagcgagtccctggtggtgatggcgatgtaccaattttgacaactgaagacgacatggtttctcagccagcaaaaatactaaactttttaagaaaacagaaatataatgctgattatgaactctcagcaaaacaaggggcagatacattggcttatattgctctcctcgaagagaagcttctccctgcagtgcttcacacattctgggttgagagtgacaattactttactgtgacaaagccatggtttgcttcacaaattccttttcctttgagtttgatcctgcctggaagaatgtctaagggagcactgaataggattctcctgaccagaggacagcctcccctctaccacctccgagaagtggaagcacagatatacagagatgccaaggagtgcctaaatcttctatcaaacagattgggaacatctcagtttttctttggagatacgccttctaccttggatgcctatgtttttggttttcttgcacctctttacaaagtacggtttcctaaagttcagctacaagaacatctgaaacagctctccaacctctgtcgcttttgtgatgacatcctgagcagttattttaggcttagtcttggaggcatctctccagctggacaagaaacggtagatgcaaatctgcagaaactcacacaacttgtaaataaggaatccaacttgattgaaaagatggatgacaatcttcgccaaagccctcagcttcctcctcggaaactgccaacacttaaattgactccagcagaagaagaaaataattccttccaacggctttcgccctgagagtagtcatggtttgtggccaaagtcaaacgattgttgcagtaatctcttacaccaagtgtgtgaaggcaaaaagaagataccataataggtattaaggaagactctaaaccaaaaggaactttctatgccatctatttttactattattattaggaagcttgtattctagcttggcactgcatttttaataacaaagagaatgctaaatgaacttggttgggggggcggggaagaaaaacacatcgtactgtatacaaagaactgccttaatcatggcagatttttgcctttggttcacatgttgctgaccaaaggctacaattctgttctgaatgtgcactcctaatttatttgatttaatttattcaatttattaacttagttttcttagaccaggctgaatacctaatatgtggctttttggctgaggctttttacttctgtttagaaatttgatgcctattttaggaaccagaaaaagataaattgcttcagtagaagagaccatatttaactttaaaaagtgaggaggaatgtgctttttaattatgctctcataagtctaatcttttgggggtttagtagcacatagataaatattaaaggtggttacatataataacatctgataatactcatttcagtataacattggtctttgctgatgtgttcgatataggttaggaagagttcttttagtttacttgggcaaatgtggcagttttagacctatgtctttgtagtacatcttcagttgtctttcttgtattaattccagaagaagtgaatgtactggttatcgttactatgctaggctgtaaaattcttactgaaattgcccacttgttagacactactcaggaggagcccatggccagggtagtagaaatactgtgcatctggtccaagttttctatgcttggctcatattctttcataagatgcatattctttcataagatgcatatcatgtagtcaaaagctttctgacaaccaattatttttcatatgtttcacttatagtcgaagaatacaaaggaacaatcagaaatagcagcttttaatgaatattttctatttattggttgctgaactgttaagggatttgctgtgtggtaattttacttataatagaaacttgcttattttagtggttgaggtgcttctgttgtcctaaaactacttctgaggtttttaaaatgtagaaccatgtttttgattagtgtcttaaaagattactgtggtgctcagcaaatcttatcaagtcgtgcaggaacccatatgttaagaaaatgagctttgtagtcaaaagactcatctaatttgagctgagtggagctcagctgtgtttgacccacatcctcccaatttgttctgtatttaggtagttatttatacaagagtctttaagtcattctaaatattttttcttgaaagttttaactaagtgagaaataaggtagtcttcaaaatcttggtcatctgtttggatgagggaaagtacctcatgagttgcacattacttctacaacagggtgtgtgtgtgtgtgtttgtgtgtgtcagtcatcttcaaaggcagattattagattccagcaatctgaaatctattattccagcagtctgaaacctaaatatgttatattggaaatcatgactgtgagactttattgtcctctaggatggatgtatattggagaagggtggttagcacattcatcagacatctgcttatgctgtggtcaaggccagtcatttttaatttatatcagatttatatcagaccctccaaaaagtatttgaaatatattacagttataacgtacaagtacattacatgtatattacaagtatattacatgtaaaacaggacaatttaaaaattttaaattttaaagaattaaaaattttaaaaatttaaattaaaaaaattaaaaatttatagaaccatatcaacactgacagattctaaaattaagtagtaaatttaactccaagtttctccatgggcaaagtcaaaagataatgctaggttatgtcaatttttcttttcaacaaaactgctaatgtctattaggaagaaaaatgtgtttaaagttttacaggaacgtggagctcatgttcttctgatatgtagactttgataaagaagcatactgtaatgttttatgaactgaaattttaatcaaaagaggtcattttagaataacaagtattattcttttttagtagagggaatgactgtcaatatgatttatttgtttttgtgtcatccctactttgaactgctgttagccttacattctcactatagtccataatgcttccagatcaccttttctaagatgcaacatgtgagtttagtgagagtttatatgttgggttacttagttgagctatttatgtataagtaaatgagatgacaggaagctgtaactgagcacaaagtactttagggagcagccacacatacaggaagctcttagaaaagaacttttttttttttttgagacagagtttcactcttgttgcccaggctggagtgcagtagcgcagtctcggctcactgcaacctctacctcctgggttcaagcaagtctcctgtctcagcctcccaagtagctgggattacaggcatgtgccaccatgcccagctaattttgttttttttttagtcgagacggggtttcaccatgttgctcaggctggtcttgaactcctgacctcaagtgattcacctgcctcggcctcccaaagtgctgggattacaggcgtgagccactgcgcccggccaaaaagaacattttgtcaatctgaacagagcacagaacattttttcagactgaacagactgttggaccagcctgtcatgatatgttttagataaagtttgagtgagttcattgggataaatggtccacaatcttaaacagaatactgtgagccaatgccttttggaagtaatggtggaggataatatgattaaagggaacatgcttgtgtttatttttgttggtagtatatgattagaaaaactagataattcccataagatgaagatcttccatgaacaaactaccatcaatcatccatcagattgattttttttttttttttaagtaacactaaagaagctgtaaagaacattgaaggtggtcattccttcaaaactgtgttttgaccacacaaggtgggcattaacaaaccaaatttcaacttaagtttgtttgtattatattgggggtgctgcgagactggagattttataaaagcaagcatttttatttccatttataatttctattcaatattgctagatatattaacatgaaggaatggggaagcttatttcaatcaaagctaaaattttcagaagtctgtaaaaatggaaaaacaccattgaaagaggcagaaacaggtaagggggatagtatcttagaaaacctgttggttaaggcagctgcatgtgataaaagtggtacttgaacttggtagtgtttccttagaacctcctccaaaaatatgcatttaccaggcttgttacaattttttgacagtttttcatcaactgtcaaaaacttcaacccttttaaaacctagatataaatgcttacatgtaaagaaaggaagctaagcagtgggtacctgggatctctctgaactatttttataacttcttgtgagtcttaagtatttcaaaataaaagtggttttaaagtaaattcatagattaaatgtatcattatctatatataaaccatgatttaaaactttaattttctaaacatagtattcaacttagttgaataaatatatgatagaagttaaatagaatttttatttcattcttaagaaaaactcatgtttgtaacaaatgatatctaaagatctattttgccttaccagaaaagaaaaaaaaaa

SEQ ID NO: 153173 - DNA, 1280 bp, Homo sapiens
  Payload ID: 10138
  Gene Symbol: MTX3
  Gene Name: metaxin 3
  Uniprot ID: Q5HYI7
  ENST ID: ENST00000512528
  CDS Start-End: 22-960
gtaaaggtcggcccgcgcaagatggcggcccccttggaactcagttgctggggaggcggctggggactcccatcggttcacagcgagtccctggtggtgatggcttatgccaaattttctggtgcacccttgaaagtcaatgtgatagataacacctggagaggttcaagaggcgatgtaccaattttgacaactgaagacgacatggtttctcagccagcaaaaatactaaactttttaagaaaacagaaatataatgctgattatgaactctcagcaaaacaaggggcagatacattggcttatattgctctcctcgaagagaagcttctccctgcagtgcttcacacattctgggttgagagtgacaattactttactgtgacaaagccatggtttgcttcacaaattccttttcctttgagtttgatcctgcctggaagaatgtctaagggagcactgaataggattctcctgaccagaggacagcctcccctctaccacctccgagaagtggaagcacagatatacagagatgccaaggagtgcctaaatcttctatcaaacagattgggaacatctcagtttttctttggagatacgccttctaccttggatgcctatgtttttggttttcttgcacctctttacaaagtacggtttcctaaagttcagctacaagaacatctgaaacagctctccaacctctgtcgcttttgtgatgacatcctgagcagttattttaggcttagtcttggaggcatctctccagctggacaagaaacggtagatgcaaatctgcagaaactcacacaacttgtaaataaggaatccaacttgattgaaaagatggatgacaatcttcgccaaagccctcagcttcctcctcggaaactgccaacacttaaattgactccagcagaagaagaaaataattccttccaacggctttcgccctgagagtagtcatggtttgtggccaaagtcaaacgattgttgcagtaatctcttacaccaagtgtgtgaaggcaaaaagaagataccataataggtattaaggaagactctaaaccaaaaggaactttctatgccatctatttttactattattattaggaagcttgtattctagcttggcactgcatttttaataacaaagagaatgctaaatgaacttggttgggggggcggggaagaaaaacacatcgtactgtatacaaagaactgccttaatcatggcagatttttgcctttggttcacatgttgctgaccaaaggct

SEQ ID NO: 153174 - DNA, 6155 bp, Homo sapiens
  Payload ID: 10138
  Gene Symbol: MTX3
  Gene Name: metaxin 3
  Uniprot ID: Q5HYI7
  ENST ID: ENST00000617335
  CDS Start-End: 25-501
atagtaaaggtcggcccgcgcaagatggcggcccccttggaactcagttgctggggaggcggctggggactcccatcggttcacagcgagtccctggtggtgatggcttatgccaaattttctggtgcacccttgaaagtcaatgtgatagataacacctggagaggttcaagaggcgatgtaccaattttgacaactgaagacgacatggtttctcagccagcaaaaatactaaactttttaagaaaacagaaatataatgctgattatgaactctcagcaaaacaaggggcagatacattggcttatattgctctcctcgaagagaagcttctccctgcagtgcttcacacattctgggttgagagtgacaattactttactgtgacaaagccatggtttgcttcacaaattccttttcctttgagtttgatcctgcctggaagaatgtctcagcaaatcttatcaagtcgtgcaggaacccatatgttaagaaaatgagctttgtagtcaaaagactcatctaatttgagctgagtggagctcagctgtgtttgacccacatcctcccaatttgttctgtatttaggtagttatttatacaagagtctttaagtcattctaaatattttttcttgaaagttttaactaagtgagaaataaggtagtcttcaaaatcttggtcatctgtttggatgagggaaagtacctcatgagttgcacattacttctacaacagggtgtgtgtgtgtgtgtttgtgtgtgtcagtcatcttcaaaggcagattattagattccagcaatctgaaatctattattccagcagtctgaaacctaaatatgttatattggaaatcatgactgtgagactttattgtcctctaggatggatgtatattggagaagggtggttagcacattcatcagacatctgcttatgctgtggtcaaggccagtcatttttaatttatatcagatttatatcagaccctccaaaaagtatttgaaatatattacagttataacgtacaagtacattacatgtatattacaagtatattacatgtaaaacaggacaatttaaaaattttaaattttaaagaattaaaaattttaaaaatttaaattaaaaaaattaaaaatttatagaaccatatcaacactgacagattctaaaattaagtagtaaatttaactccaagtttctccatgggcaaagtcaaaagataatgctaggttatgtcaatttttcttttcaacaaaactgctaatgtctattaggaagaaaaatgtgtttaaagttttacaggaacgtggagctcatgttcttctgatatgtagactttgataaagaagcatactgtaatgttttatgaactgaaattttaatcaaaagaggtcattttagaataacaagtattattcttttttagtagagggaatgactgtcaatatgatttatttgtttttgtgtcatccctactttgaactgctgttagccttacattctcactatagtccataatgcttccagatcaccttttctaagatgcaacatgtgagtttagtgagagtttatatgttgggttacttagttgagctatttatgtataagtaaatgagatgacaggaagctgtaactgagcacaaagtactttagggagcagccacacatacaggaagctcttagaaaagaacttttttttttttttgagacagagtttcactcttgttgcccaggctggagtgcagtagcgcagtctcggctcactgcaacctctacctcctgggttcaagcaagtctcctgtctcagcctcccaagtagctgggattacaggcatgtgccaccatgcccagctaattttgttttttttttagtcgagacggggtttcaccatgttgctcaggctggtcttgaactcctgacctcaagtgattcacctgcctcggcctcccaaagtgctgggattacaggcgtgagccactgcgcccggccaaaaagaacattttgtcaatctgaacagagcacagaacattttttcagactgaacagactgttggaccagcctgtcatgatatgttttagataaagtttgagtgagttcattgggataaatggtccacaatcttaaacagaatactgtgagccaatgccttttggaagtaatggtggaggataatatgattaaagggaacatgcttgtgtttatttttgttggtagtatatgattagaaaaactagataattcccataagatgaagatcttccatgaacaaactaccatcaatcatccatcagattgattttttttttttttttaagtaacactaaagaagctgtaaagaacattgaaggtggtcattccttcaaaactgtgttttgaccacacaaggtgggcattaacaaaccaaatttcaacttaagtttgtttgtattatattgggggtgctgcgagactggagattttataaaagcaagcatttttatttccatttataatttctattcaatattgctagatatattaacatgaaggaatggggaagcttatttcaatcaaagctaaaattttcagaagtctgtaaaaatggaaaaacaccattgaaagaggcagaaacaggtaagggggatagtatcttagaaaacctgttggttaaggcagctgcatgtgataaaagtggtacttgaacttggtagtgtttccttagaacctcctccaaaaatatgcatttaccaggcttgttacaattttttgacagtttttcatcaactgtcaaaaacttcaacccttttaaaacctagatataaatgcttacatgtaaagaaaggaagctaagcagtgggtacctgggatctctctgaactatttttataacttcttgtgagtcttaagtatttcaaaataaaagtggttttaaagtaaattcatagattaaatgtatcattatctatatataaaccatgatttaaaactttaattttctaaacatagtattcaacttagttgaataaatatatgatagaagttaaatagaatttttatttcattcttaagaaaaactcatgtttgtaacaaatgatatctaaagatctattttgccttaccagaaaagaaaaaaaaaaccctaaaaccaaaaactccttttccctaggaagtcaaaaatgctgtgatttaaaatatctaattatatttttttctttctatggtagtggggtttacttctgaggataaaatattttgaaaaagctctgtcccttgacatggtagttctcccgtgccttgtacttgttctctctccatatgcacagtgtgacaagatgctcacctttaatgaagaaggtgtagcttttcgttttaagctgtaattgtctttgtcttgatttggctatttttataactgaaatcctgagcaacagagataatttgggtggtaatgatcatcttttgtatatgttcttgatgttaagaaatattttttgctgccattcagctttgtggaatttatgtttacttttcaatattttcatatttcttaaccagattttaaagaaatttgttgttagttacgtgaaatcaaaggtcaggtcagtaagcccattatcctcaaacttgaagtttcgttggatgttcaaaatgctaatttttgcagagatataaggataaattagttttagtttgtgttcttaagggtttgcaaaataatttggctcccaaactcttgttggggtgtagtgtttgctaggagcccaggatacctgccctggacttaaattgtgattgaagtggagaggtactctaggaatttaaaaagacacaaaattatttttttccagactagtgtgccatggatttctgataagaattaacattcttgaacaaaggtatcagaaagggtaactcgagttgaaggtttgtgaatagaaggggaaatgtgatagaagattattcagaacaaaataagtagacaaaataacaaaagacaggaaaataagtctctttgtatccttattaatcatttgaaattatgctataatattttttaaaactcacctgtttggttctgggtgaagcagttcctgaaggagtgttttgtcagaatatattgttaggagaatagagggttctgtggccaagtaagtttgggaaatagtgggttagacaaagttgagttactgttggcctttcagacctttgatacgctaatgtgcattttaaatctccaagaagcacctctattttatacatcatttccctaatttattttaatatggatttcttgtttttgttttcttgagacggagtcttggtcttgtcacccaggctggagtgcagtggcacgatctcggctcactacaacctccgcctcccaggttcaagcgattctcctgcctcagcctcccaatttactgggattacaggcacctgccaccacgcccagctaatttttgtatttttagtagagatggggtttcaccatgttgaccaggctgattttgaactcctgacctcaggtgattctgcccgcctcaccctcccacagtgctggaattataggtatgagccactgtccccggccagatttttttaaaagtaggtatcttgtgggatttatgttctgagagatacacctaaggaaatgctgccctacagtgtttttgctagttcatactcattacaaaggtttcttgttgttgggtgcccctctagccagtggtagtaaaatgggaagagacaggtcaagactcccttggaccatggcattgagagagggatggctgtcggcatagatatgttggttatttaggcatttgtgagggaggcccctggctcttccagcctgtttccttaggatcccagttggccgggaacagctgtacaagggtctgctgaactggtggtttcagcagactacccagttcctaagcatccatgagacagagggaaccaacttgtatttccagaacaattttccaaaccttttctggctgtactttaaaagtgccaaaaaggcaatgggtgtttatgacactaaagtcacatacaagctagtatgatacatacatcatagaaagcttatagttgctcagtgacaaagcaaaggaagtttaatattttccagttttgttcattaccgaagacagtctacggttcatagttttcactaaattctaagcagattctatatcctaaaacatttaaacctcactaggcctgcaattttgagagggttagctaaatatgtttggtatcacttcagagtctaaaaccagattactaatcgtgtgtaaggaggcattttgtgtgtctttgcaatgtatacaattggattatttggaacaccattttgaatgtgtatttgagagaaagctcgcctgtgggttttgagttgtggtgtaatggtgaacatgtagccacgtgaaaggccgttggatctttgttctgattcttcagtcgtcttcttgcaaattcagagaaatgtcttttaatcatttcgtttacatatcccagatccttggaaatcatgaaaaataacttgccagagtttgcatcagccctcagtaagtcatgaaccatagagaaggtcatggggccatttattctttggaccactggctacttctgaagttctggcttccttctctctaggaggagtcgtgtattcaagcttttaagttaaatgcataaaaatgagttttacttctcttctgacttgatttttaattttatgaaatgggaaataatgtttttccatttttctgttcattttgaagtgggaatttgaggtgtttgtaatgtcatgttactgttctgaaagattgacagtaaagaagacaagaaatatatgtatgtagtatgcatattagttttgtcccaccaagcctatctttgaatggcaaacattttaaaaacatctgttctagttgcacaactactctagcttctttataaagtaaacaatcttaaagtaagcaatgttggccataatttcaatattctagccttgccgagtgtgaatatattttactcagagactatgtacaaatacactaaagtggtgatggtgatcaatattgtaaagaatttattctgataaatgagaaactggatataatgtcaaaatagctattttctcaataaaaatctcaaatctc

SEQ ID NO: 153175 - DNA, 915 bp, Homo sapiens
  Payload ID: 10139
  Gene Symbol: METRN
  Gene Name: meteorin, glial cell differentiation regulator
  ENST ID: ENST00000219542
  CDS Start-End: 1-564
ctggccccggctgcccgcgccggctactccgaggagcgctgcagctggaggggcagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcggtgagtgtccccgccatggggggagcctggagcctgccttcccctgaatgcctaccgcagccacatgcctccccacagtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggg

SEQ ID NO: 153176 - DNA, 3325 bp, Homo sapiens
  Payload ID: 10139
  Gene Symbol: METRN
  Gene Name: meteorin, glial cell differentiation regulator
  Uniprot ID: Q9UJH8
  ENST ID: ENST00000568223
  CDS Start-End: 176-1057
tccaaggcggccccggcgctggggctgcgcggcaggcggagcggccgcgggcttgggggcttcgccggggccgggcggccggcgcccccggctgctcccgccgccgcccggacccgcgccccgccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcgtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgcaagctgctgtggacctggtctcctgtgtccagcccagccttgggcctgcctcgcagctgtgaggatggctccaattcctgcctcctggcgggagactgaggctcaggggaatggtatcttgttcaagaccatttggcaactgagagggagagcagatgtcaggaggagctacacccacattccggggaggggccgctgctgggtggggggcacgtggggacctgcactcatgcaagcttctgctctgctgcacccaccagccccgtccttgcccgcacccttgcctgcttccctggctggctcccacttgcctcccgtgccaggtgcttctggggctcagcaggagaggaaaggggcagaggggcatagggtccctcgggtacggtgggggcaggcgggcgcacagcgctccggctctgagccaggcctgtgagggaaggggctgcaggctggcagggtgccgacttcccccatggctgctgtgagcccgcagagtcatccttggccccgtcccgcccttggggaagaatgggcccctctgtcctcaggccccttcgacgtgctgagcatccagacgtggcgaggagcccgaagggtgtggggtcccctctgcagggtcctgcttgttgcctgtttccggcgggcggggtgcacaatggggtctctaaggaccgtttcccgccactggccccattgtcactgtctccgccttcctcctcggcctttcagccgcataaagggccagtgaggtttgggacagccacagcccaaggctccgaggctaaaagcccctgggtgggggtgttccaggacacctggccctgtgtgagctgcctcctctcaccccaacccctcggatcctgggaaagagacagccatggctcaagggccagggacccctgggctgagccccagaaatggctttccattctcgcctgggccggggtgggggtggaggccagaggccctgcccaggcagatgaagcccccagctttcaagggggaaactgaggctgtgtgagggacacagctgtgcagggcccacaaacacggtcctttctctaggttagcggatgcagatgcctgatgagtgccatgccctctgtggacacctggggaggggggtcacctccagcgccgccctgggacttccactgcacgtgcaagagacttaccctttcacacagatcacctgcctgccgcagggctgatgaggatgggtgaggagcgcagccactgggtgtcatgcactgtgggggttctcccaccttctgcccctcctcaggttccttgctgcttctctcctctcccaactgtggcacgctgagggctcaggcacaggaccgctcctctggggcagcctccaataacccttggacaacctccactttttcatcttcagccctgaccactccctggggcccatagccttacatccatctgcccccagcccaaacacttctgcaaacactagaaaaggaggtagcccgtgtgccctcctgcaccgcctcctccactcctgtcttggagaggctttcccgtgggccgagcaacccccttacctttggcacttgccctgattctctggccagcttcctacaacctctccttttcagccacacccaagtccacctgttcacaaacaccctgggctgggccctggccgaaccctggcttctacctacctgtctcaggaagtgcctgagccttgcacctacagaccctcccagagaaagccctggctttgcaaccagctgtcttctcatgagacacagggccacaggagcaccacggtgcccaaatgggtcttggagcattagaccaggggcttcatgcctgccctggggacaggtggccaaagtggcatgggagatagggagacagtgtgggtgagcaggtgggcaggagctacaggagcctggggcctgtggatcacagacaccgccaggcaagtgccagttcacacaggtacaggtggctgcagagtgcccaaaggccaagcagcagagtgcctggtgtggacgggagaggagtggggaggttgggcgcagtggctcacgcctgtaatcccaacactttgggaggcccaggcaagcagatcatgaggtcaggagatggagaccatcctggccaacatggtgaaaccgtctctaataaaacacaaaaaattagccaga

SEQ ID NO: 153177 - DNA, 503 bp, Homo sapiens
  Payload ID: 10139
  Gene Symbol: METRN
  Gene Name: meteorin, glial cell differentiation regulator
  ENST ID: ENST00000570132
  CDS Start-End: 54-263
gccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcgtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcc

SEQ ID NO: 153178 - DNA, 612 bp, Homo sapiens
  Payload ID: 10139
  Gene Symbol: METRN
  Gene Name: meteorin, glial cell differentiation regulator
  ENST ID: ENST00000568415
  CDS Start-End: 37-519
tcagacctcagatccgggaaactagaggggtcccagatgctggggtgcatatgtcagatgggagtgcaggagggcggcccaggacagctgatcgctaggcatggcccccaggcccacgtctgtgtgcattcctgccttggaggtgcctgcaggccctgcagcgacgctgagctgctcctggccgcatgcaccagcgacttcgtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtgggcccactgctttggaggtgatgggactatcaataagaactctgttcacgcaa

SEQ ID NO: 153179 - DNA, 523 bp, Homo sapiens
  Payload ID: 10139
  Gene Symbol: METRN
  Gene Name: meteorin, glial cell differentiation regulator
  ENST ID: ENST00000567076
  CDS Start-End: 1-523
cgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgcctgcaggccctgcagcgacgctgagctgctcctggccgcatgcaccagcgacttcgtaattcacgggatcatccatggggtcacccatgacgtggagctgcaggagtctgtcatcactgtgggtgggcccactgctttggaggtgatgggactatcaataagaactctgttcacg

SEQ ID NO: 153180 - DNA, 1605 bp, Homo sapiens
  Payload ID: 10140
  Gene Symbol: METRNL
  Gene Name: meteorin, glial cell differentiation regulator-like
  Uniprot ID: Q641Q3
  ENST ID: ENST00000320095
  CDS Start-End: 126-1061
gcggggggcgcgcgacgtgaccacccggactcgaagcccgccccgcccccgcccggctcgccggctccggggtctgctccgggggtcgcggacgcggggccgggcggcggagccggcgccagagcatgcggggcgcggcgcgggcggcctgggggcgcgcggggcagccgtggccgcgaccccccgccccgggcccgcccccgccgccgctcccgctgctgctcctgctcctggccgggctgctgggcggcgcgggcgcgcagtactccagcgaccggtgcagctggaaggggagcgggctgacgcacgaggcacacaggaaggaggtggagcaggtgtatctgcgctgtgcggcgggtgccgtggagtggatgtacccaacaggtgctctcatcgttaacctgcggcccaacaccttctcgcctgcccggcacctgaccgtgtgcatcaggtccttcacggactcctcgggggccaatatttatttggaaaaaactggagaactgagactgctggtaccagacggggacggcaggcccggccgggtgcagtgttttggcctggagcagggcggcctgttcgtggaggccacgccgcagcaggatatcggccggaggaccacaggcttccagtacgagctggttaggaggcacagggcgtcggacctgcacgagctgtctgcgccgtgccgtccctgcagtgacaccgaggtgctcctagccgtctgcaccagcgacttcgccgttcgaggctccatccagcaagttacccacgagcctgagcggcaggactcagccatccacctgcgcgtgagcagactctatcggcagaaaagcagggtcttcgagccggtgcccgagggtgacggccactggcaggggcgcgtcaggacgctgctggagtgtggcgtgcggccggggcatggcgacttcctcttcactggccacatgcacttcggggaggcgcggctcggctgtgccccacgcttcaaggacttccagaggatgtacagggatgcccaggagagggggctgaacccttgtgaggttggcacggactgactccgtgggccgctgcccttcctctcctgatgagtcacaggctgcggtgggcgctgcggtcctggtggggccgtgcggtgagggccgcgcgctgggagccgcatgccctgggcccaggcctgaccctggtaccgaagctgtggacgttctcgccacactcaaccccatgagcttccagccaaggatgccctggccgattggaaatgctgtaaaatgcaaactaagttattatatttttttttggtaaaaaagaaatgtccataggaaacaaattcccgtgtcttaaaacgccttggtgtgccgtctgatactgttctctaaagacgttaggagtcacggcatctggcctgcggttgggtgaagcactggccgttgggcacagtggatgtgtgaaaaggtgccattcagagttgttattctcatgacggaagttttggagccaaataatacgttttttattttcattttatttttaaaggatgagctttggtccttttcaggccgccggttgtttccgttcccgagaataaagacgaggatccga

SEQ ID NO: 153181 - DNA, 545 bp, Homo sapiens
  Payload ID: 10140
  Gene Symbol: METRNL
  Gene Name: meteorin, glial cell differentiation regulator-like
  ENST ID: ENST00000574053
  CDS Start-End: 1-273
cgcacagccgttcgaggctccatccagcaagttacccacgagcctgagcggcaggactcagccatccacctgcgcgtgagcagactctatcggcagaaaagcagggtcttcgagccggtgcccgagggtgacggccactggcaggggcgcgtcaggacgctgctggagtgtggcgcgcggctcggctgtgccccacgcttcaaggacttccagaggatgtacagggatgcccaggagagggggctgaacccttgtgaggttggcacggactgactccgtgggccgctgcccttcctctcctgatgagtcacaggctgcggtgggcgctgcggtcctggtggggccgtgcggtgagggccgcgcgctgggagccgcatgccctgggcccaggcctgaccctggtaccgaagctgtggacgttctcgccacactcaaccccatgagcttccagccaaggatgccctggccgattggaaatgctgtaaaatgcaaactaagttattatatttttttttggtaaaaaagaaatgtccataggaaacaaa

SEQ ID NO: 153182 - DNA, 967 bp, Homo sapiens
  Payload ID: 10140
  Gene Symbol: METRNL
  Gene Name: meteorin, glial cell differentiation regulator-like
  Uniprot ID: Q641Q3
  ENST ID: ENST00000570778
  CDS Start-End: 108-797
cccgggggaggcgcgcctgcagcgcggccggcgggctgacgcacgaggcacacaggaaggaggtggagcaggtgtatctgcgctgtgcggcgggtgccgtggagtggatgtacccaacaggtgctctcatcgttaacctgcggcccaacaccttctcgcctgcccggcacctgaccgtgtgcatcaggtccttcacggactcctcgggggccaatatttatttggaaaaaactggagaactgagactgctggtaccagacggggacggcaggcccggccgggtgcagtgttttggcctggagcagggcggcctgttcgtggaggccacgccgcagcaggatatcggccggaggaccacaggcttccagtacgagctggttaggaggcacagggcgtcggacctgcacgagctgtctgcgccgtgccgtccctgcagtgacaccgaggtgctcctagccgtctgcaccagcgacttcgccgttcgaggctccatccagcaagttacccacgagcctgagcggcaggactcagccatccacctgcgcgtgagcagactctatcggcagaaaagcagggtcttcgagccggtgcccgagggtgacggccactggcaggggcgcgtcaggacgctgctggagtgtggcgtgcggccggggcatggcgacttcctcttcactggccacatgcacttcggggaggcgcggctcggctgtgccccacgcttcaaggacttccagaggatgtacagggatgcccaggagagggggctgaacccttgtgaggttggcacggactgactccgtgggccgctgcccttcctctcctgatgagtcacaggctgcggtgggcgctgcggtcctggtggggccgtgcggtgagggccgcgcgctgggagccgcatgccctgggcccaggcctgaccctggtaccgaagctgtggacgttctcgccacactcaaccccatga

SEQ ID NO: 153183 - DNA, 1900 bp, Homo sapiens
  Payload ID: 10140
  Gene Symbol: METRNL
  Gene Name: meteorin, glial cell differentiation regulator-like
  Uniprot ID: Q641Q3
  ENST ID: ENST00000571814
  CDS Start-End: 942-1631
ttctgtttagcatgtatgagggtgaacttagcttgctactcacacactactcaccctgtggaggaagttcgcctcgcttttgtggtgagtcttgctgtaatgatagcttatatttacaaataccgtcggcagtgcagggtcttcaggcttgcagaaaacggtcaagtcattactttgagaaatgtacaaacatctatgcttaatgaggtgctaaaagacaaaactcatctacaacctccttccccccaaactgccaacactctggattaacttaaaagctgctctctgggcaggttgcatcccagggctcctccttcacacgtggtggggccccaccttcgctttacctctagcgtcccagccctcgtggtcatctggaaccagggttggtacacagggcctgctggcattcctgtgatactccgtgatattctggaggaatccatcccttccctggggctccatcccactgccccagcacctccagccaccctgattcagggacatcgcagagattggtgtttgacgctacggcagcagaggcgcagactcttgagtgttggagggtgtctggagggcctggggacaagcaccgcctgcactcccgggagctcggccccgccccaccatggctcttggtgcaggtgcactggaaggaactgggtggggcccttgtgccgaagggcggagatggcgccggcctgcctcacgggcaggggtccgtgtggcacctgtggccggcagcgggtgggtccaggagccgccatcatttggagcgggtatcgtcctcactgactctctgtgggtgcgggtggggtgtgtgacgggagctccgggcctggctgacagtgtctctcctctgcagcgggctgacgcacgaggcacacaggaaggaggtggagcaggtgtatctgcgctgtgcggcgggtgccgtggagtggatgtacccaacaggtgctctcatcgttaacctgcggcccaacaccttctcgcctgcccggcacctgaccgtgtgcatcaggtccttcacggactcctcgggggccaatatttatttggaaaaaactggagaactgagactgctggtaccagacggggacggcaggcccggccgggtgcagtgttttggcctggagcagggcggcctgttcgtggaggccacgccgcagcaggatatcggccggaggaccacaggcttccagtacgagctggttaggaggcacagggcgtcggacctgcacgagctgtctgcgccgtgccgtccctgcagtgacaccgaggtgctcctagccgtctgcaccagcgacttcgccgttcgaggctccatccagcaagttacccacgagcctgagcggcaggactcagccatccacctgcgcgtgagcagactctatcggcagaaaagcagggtcttcgagccggtgcccgagggtgacggccactggcaggggcgcgtcaggacgctgctggagtgtggcgtgcggccggggcatggcgacttcctcttcactggccacatgcacttcggggaggcgcggctcggctgtgccccacgcttcaaggacttccagaggatgtacagggatgcccaggagagggggctgaacccttgtgaggttggcacggactgactccgtgggccgctgcccttcctctcctgatgagtcacaggctgcggtgggcgctgcggtcctggtggggccgtgcggtgagggccgcgcgctgggagccgcatgccctgggcccaggcctgaccctggtaccgaagctgtggacgttctcgccacactcaaccccatgagcttccagccaaggatgccctggccgattggaaatgctgtaaaatgcaaactaagttattatatttttttttggtaaaaaagaaatgtccataggaaac

SEQ ID NO: 153184 - DNA, 967 bp, Homo sapiens
  Payload ID: 10140
  Gene Symbol: METRNL
  Gene Name: meteorin, glial cell differentiation regulator-like
  Uniprot ID: Q641Q3
  ENST ID: ENST00000616599
  CDS Start-End: 108-797
cccgggggaggcgcgcctgcagcgcggccggcgggctgacgcacgaggcacacaggaaggaggtggagcaggtgtatctgcgctgtgcggcgggtgccgtggagtggatgtacccaacaggtgctctcatcgttaacctgcggcccaacaccttctcgcctgcccggcacctgaccgtgtgcatcaggtccttcacggactcctcgggggccaatatttatttggaaaaaactggagaactgagactgctggtaccggacggggacggcaggcccggccgggtgcagtgttttggcctggagcagggcggcctgttcgtggaggccacgccgcagcaggatatcggccggaggaccacaggcttccagtacgagctggttaggaggcacagggcgtcggacctgcacgagctgtctgcgccgtgccgtccctgcagtgacaccgaggtgctcctagccgtctgcaccagcgacttcgccgttcgaggctccatccagcaagttacccacgagcctgagcggcaggactcagccatccacctgcgcgtgagcagactctatcggcagaaaagcagggtcttcgagccggtgcccgagggtgacggccactggcaggggcgcgtcaggacgctgctggagtgtggcgtgcggccggggcatggcgacttcctcttcactggccacatgcacttcggggaggcgcggctcggctgtgccccacgcttcaaggacttccagaggatgtacagggatgcccaggagagggggctgaacccttgtgaggttggcacggactgactccgtgggccgctgcccttcctctcctgatgagtcacaggctgcggtgggcgctgcggtcctggtggggccgtgcggtgagggccgcgcgctgggagccgcatgccctgggcccaggcctgaccctggtaccgaagctgtggacgttctcgccacactcaaccccatga

SEQ ID NO: 153185 - DNA, 5472 bp, Homo sapiens
  Payload ID: 10140
  Gene Symbol: METRNL
  Gene Name: meteorin, glial cell differentiation regulator-like
  Uniprot ID: Q641Q3
  ENST ID: ENST00000633913
  CDS Start-End: 125-1060
gcggggggcgcgcgacgtgaccacccggactcgaagccgccccgcccccgcccggctcgccggctccggggtctgctccgggggtcgcggacgcggggccgggcggcggagccggcgccagagcatgcggggcgcggcgcgggcggcctgggggcgcgcggggcagccgtggccgcgaccccccgccccgggcccgcccccgccgccgctcccgctgctgctcctgctcctggccgggctgctgggcggcgcgggcgcgcagtactccagcgaccggtgcagctggaaggggagcgggctgacgcacgaggcacacaggaaggaggtggagcaggtgtatctgcgctgtgcggcgggtgccgtggagtggatgtacccaacaggtgctctcatcgttaacctgcggcccaacaccttctcgcctgcccggcacctgaccgtgtgcatcaggtccttcacggactcctcgggggccaatatttatttggaaaaaactggagaactgagactgctggtaccggacggggacggcaggcccggccgggtgcagtgttttggcctggagcagggcggcctgttcgtggaggccacgccgcagcaggatatcggccggaggaccacaggcttccagtacgagctggttaggaggcacagggcgtcggacctgcacgagctgtctgcgccgtgccgtccctgcagtgacaccgaggtgctcctagccgtctgcaccagcgacttcgccgttcgaggctccatccagcaagttacccacgagcctgagcggcaggactcagccatccacctgcgcgtgagcagactctatcggcagaaaagcagggtcttcgagccggtgcccgagggtgacggccactggcaggggcgcgtcaggacgctgctggagtgtggcgtgcggccggggcatggcgacttcctcttcactggccacatgcacttcggggaggcgcggctcggctgtgccccacgcttcaaggacttccagaggatgtacagggatgcccaggagagggggctgaacccttgtgaggttggcacggactgactccgtgggccgctgcccttcctctcctgatgagtcacaggctgcggtgggcgctgcggtcctggtggggccgtgcggtgagggccgcgcgctgggagccgcatgccctgggcccaggcctgaccctggtaccgaagctgtggacgttctcgccacactcaaccccatgagcttccagccaaggatgccctggccgattggaaatgctgtaaaatgcaaactaagttattatatttttttttggtaaaaaagaaatgtccataggaaacaaattcccgtgtcttaaaacgccttggtgtgccgtctgatactgttctctaaagacgttaggagtcacggcatctggcctgcggttgggtgaagcactggccgttgggcacagtggatgtgtgaaaaggtgccattcagagttgttattctcatgacggaagttttggagccaaataatacgttttttattttcattttatttttaaaggatgagctttggtccttttcaggccgccggttgtttccgttcccgagaataaagacgaggatccgaccagccagaagccggagtctgtctttcgccaggtccggtgcccacggcccgtgttcagggcctcgctggacgtaccccagggcgccaccctgcctcggcagacacgcttgctccgcccggcgactgtccctcagcgcctgctgctgcatttccattaatgcaggtcctgccctgtggccccagcctgcccacagtgcaggggcccacagctagtctctagacgcccaggagctggtctgaacccaggttggtgaccccatgtccccaaaggatgcggctaccagaacaaatcaccaccgactgcggggctgaaacaacctcgttctctgagttcctgaggccacaatccaaagtcacggtgtgggcagagcctctccctccagggctccaggggagaacgcttcatcttctcctcagcctccaggggttccagggaggacccttcgtcttctcctcagccgggggcgacccttcgtcttctcctcagccgggggcgacccttcgtcttctcctcagctgggggggacccttcgtcttctcctcagccagggggggacccttcatcttctcctcagcctccgggggttccagggaggaccctttgtcttctcctcagcctccgggggttcctgggaggatcttcatcttctcctcagccaggggaggaaccttcatcttctcagccagggggaggacccttcatcttctcctctgccaggggaggactcttcatcttctccttggcctctgggggctccaggtgctccttgatggtggctgcatcactccagtctctgcctccgtggccacacggcttctccctgtgtctgtgtccagatctttctctaggacattggtcactggattggggcccacaccagtgacctcgtcttaaaccgattacgtccgcaaagaccccatttccaaataaggtcacactcagcggttcctggtggacatgaaatttggggtacaccatgccccagcacagggggtccctgggagtgtcagttaaccagaccccagcctgcatccccattgatgaatcaggcagttcctcccgtgcagccgctaagagcaaaggggacctgggagagggtgatgtggtcagtgggcaccatgccggccttgccaaatgctcaggcactctgggtaagcactgtgtaccggctcagatgttcactggctcaggtgtgcaccggctcagatgttcaccggctcaggtgttcactggctcaggtgtgtactggctcaggtgtgcactggctcaggtgtgtaccgtgcactggctcaggtgtgcaccggctcaggtgtgtaccggctcaggtgtgcaccggctcagctgtgcaccggctcagctgttcactggctcaggtgtgtaccggctcaggtgtgcactggctcaggtgtgtaccgtgcactggctcaggcgttcactggctcaggtgtgtaccggctcaggtgtgcaccggctcagctgtgcaccggctcaggtgtgcaccggctcaggtgttcaccggctcaggtgtgcaccagctcaggtgtgtaccgtgcactggctcaggtgtgcaccagctcaggtgttcactggcttaggtgtgcaccggctcagatgtgtaccagctcaggtgtgcaccggctcaggtgtgtaccggctcagatgtgtgccggctcaggtgtgcactggctcaggtgtgcaccagctcagatctgagccagcacaggtctgcaggctcccacaggtcacaacaagaagcaggtgtttctgggcgaggacctgaagcagcaggctggggctgggccaggtcccactgtggctggtggtcagcacacctttgccagcaggcgccacagcacaggtgcccagcccacagcggggcggcagggaatctgctcctggaacctgggttttctgggctggctcccgggggtgttgactgacaggagaaggctgcagaacaagaaggtcgggtttcaggctggcagcctctcctcaattacagggatgctggggtaggccagaacccggtgtcaggtggagtagaagtcacgcttcacgggaggcttctgttttttaagaagtgcctgtgggctggggggtttttggtccagagtctaggggaaggcaaagcttaccaaacagaaagtgtccactccggggtgggggactggggcctcgtctctccgctgggccaggacagggctgtgaggtccagctgcctgctcagctctgggacctgtcctcctgcaggagcccacggccgtgaacatgcacacgggcagatccacatgtcccccgaggaaaaagagagggtcaaggttgagtgtgtgggtgctagggggtgcagaactcacttctaactatgagggttgaggcgggcttcacaggggaggtgggttttgagccaggcctgcagcccggcatctggaagtggcttccaggctctccctgagctctctcctgcaggacacccctgcctgcagatctgcacccccagctccttcctggggacttgatatcatgaccctgcctggcaccccaggggtgaatgctgcacccagccctgagggtttccatctgctgggggcatctgacctgggcaggccagggtgggtgggagggagtccagcgggggaggtgcagggtggccagggggagacactgccctggctggagcctggattcactaggtcatcaccaatgcagggggtcctggctcactggactttgctactagagaaggttggggagctccacatgaaggcaagaaggctggggctcagggtgtaactcatccccggagagcaaccagaaaggccgtcggattgcaacgcagcctgcattgtcctcgctgaacgcctggtcctgtcccacctgcaccggacagcaactgcttcccctccagggcggcccccatcgtcccccaggtgctgcaagagcagtgagacttacccaagacaagtcagaggctttggagctctcgggggcggtggcttctcccaggagccccgtatctgtcagtccccccataaggggaggggagttggcaaggctcctccttgctcccagcgtgaggattgcccctacttttccggcccccacttgccccctccacctgcccttttccctccgggaagccctggaggttttccaagaactctgcgggtcgagggggcagcctatgtggggtggcggggggcctcctgcttgttggatgcccagacgcctacacctttcaccctggggtccagtcggctgatggccatgagagagaagctgagagcaaccagagcccacagctccatgctggtcccccatctgcaaacgctgggccccatgggagctgtgactcggtttccagctcgtcacagggctggccgaggccccggcatgtcaagccatctcaggttgggcaggaatgtggtccgtgttcacatgtgtctctgtgtgtgtgagagagaggggtcagctgggacgctggggtggcagggacagtcctggctcacccctcatcctccctcgacctcgactccctccacatgaggagcccccccttcctggctatcctgtgagttgagcttcctctgctgggagggctttgtcagaggttccctgcggttccagaaggaaagctggctgcagggagggccgggcactggacaccgtgtggctgagcctgtggcgggggctgcacagctgggttcccagcccccctccttgtccccaccccaccgcactgggaggccctgctgaggggccagagtccggctgcaggtcccacgggtgggggtggggcccctcattagcactgcagctgacactgagggcttccacctcgctaattgattaaactgtttagaaaccagg

SEQ ID NO: 153186 - DNA, 1900 bp, Homo sapiens
  Payload ID: 10140
  Gene Symbol: METRNL
  Gene Name: meteorin, glial cell differentiation regulator-like
  Uniprot ID: Q641Q3
  ENST ID: ENST00000634158
  CDS Start-End: 942-1631
ttctgtttagcatgtatgagggtgaacttagcttgctactcacacactactcaccctgtggaggaagttcgcctcgcttttgtggtgagtcttgctgtaatgatagcttatatttacaaataccgtcggcagtgcagggtcttcaggcttgcagaaaacggtcaagtcattactttgagaaatgtacaaacatctatgcttaatgaggtgctaaaagacaaaactcatctacaacctccttccccccaaactgccaacactctggattaacttaaaagctgctctctgggcaggttgcatcccagggctcctccttcacacgtggtggggccccaccttcgctttacctctagcgtcccagccctcgtggtcatctggaaccagggttggtacacagggcctgctggcattcctgtgatactccgtgatattctggaggaatccatcccttccctggggctccatcccactgccccagcacctccagccaccctgattcagggacatcgcagagattggtgtttgacgctacggcagcagaggcgcagactcttgagtgttggagggtgtctggagggcctggggacaagcaccgcctgcactcccgggagctcggccccgccccaccatggctcttggtgcaggtgcactggaaggaactgggtggggcccttgtgccgaagggcggagatggcgccggcctgcctcacgggcaggggtccgtgtggcacctgtggccggcagcgggtgggtccaggagccgccatcatttggagcgggtatcgtcctcactgactctctgtgggtgcgggtggggtgtgtgacgggagctccgggcctggctgacagtgtctctcctctgcagcgggctgacgcacgaggcacacaggaaggaggtggagcaggtgtatctgcgctgtgcggcgggtgccgtggagtggatgtacccaacaggtgctctcatcgttaacctgcggcccaacaccttctcgcctgcccggcacctgaccgtgtgcatcaggtccttcacggactcctcgggggccaatatttatttggaaaaaactggagaactgagactgctggtaccggacggggacggcaggcccggccgggtgcagtgttttggcctggagcagggcggcctgttcgtggaggccacgccgcagcaggatatcggccggaggaccacaggcttccagtacgagctggttaggaggcacagggcgtcggacctgcacgagctgtctgcgccgtgccgtccctgcagtgacaccgaggtgctcctagccgtctgcaccagcgacttcgccgttcgaggctccatccagcaagttacccacgagcctgagcggcaggactcagccatccacctgcgcgtgagcagactctatcggcagaaaagcagggtcttcgagccggtgcccgagggtgacggccactggcaggggcgcgtcaggacgctgctggagtgtggcgtgcggccggggcatggcgacttcctcttcactggccacatgcacttcggggaggcgcggctcggctgtgccccacgcttcaaggacttccagaggatgtacagggatgcccaggagagggggctgaacccttgtgaggttggcacggactgactccgtgggccgctgcccttcctctcctgatgagtcacaggctgcggtgggcgctgcggtcctggtggggccgtgcggtgagggccgcgcgctgggagccgcatgccctgggcccaggcctgaccctggtaccgaagctgtggacgttctcgccacactcaaccccatgagcttccagccaaggatgccctggccgattggaaatgctgtaaaatgcaaactaagttattatatttttttttggtaaaaaagaaatgtccataggaaac

SEQ ID NO: 153187 - DNA, 3013 bp, Homo sapiens
  Payload ID: 10141
  Gene Symbol: MTHFSD
  Gene Name: methenyltetrahydrofolate synthetase domain containing
  Uniprot ID: Q2M296
  ENST ID: ENST00000360900
  CDS Start-End: 27-1178
aagcgtcgcacagcgactgcatcaccatggagccgagggcagtaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgccacacctggccctgggccctcggccctctgtgtccttggccttgcccccgcccgcacggctggtcacgtttgtcattgggcattcagctcagcgtcagaggctgactcagtccccagttcagagtagtcacctggttacactgaactcctcaccttcttttctctctttttttaaaaaatacttctttttctgaaagattcttatttttttttttttgtttacctttttcctgtggatttgctgccgttagaatagcaactccaggagaagagcaagtgagtcagccccccttctccactccctgccccaccggcagtgggcacagccctgcagacaggagcaaggacttcggggaatagacccactggggccgggagagggagaagctggattctgaccccaccactggcactcctgtgtccagccatgcctgacgcccaccccaccctcagacggcgggattaaaccaggcagtacagggttactcggggaagccagactgctgggatttcctgtcgctttagccagaataatccaggtatatggatatacagataatctgaaagagtttctcatttttatatttgtggaacatcgtgtaagaaaaactgaagagcaagtgcctgaaataaaatcccccacatgtatcagcctgca

SEQ ID NO: 153188 - DNA, 1210 bp, Homo sapiens
  Payload ID: 10141
  Gene Symbol: MTHFSD
  Gene Name: methenyltetrahydrofolate synthetase domain containing
  Uniprot ID: Q2M296
  ENST ID: ENST00000381214
  CDS Start-End: 20-1171
gcacagcgactgcatcaccatggagccgagggcagtaggtgtctccaaacaggacatacgtgaacaaatttggggctacatggaatcacaaaatttagctgactttccccgacctgttcatcacaggatacccaactttaagggcgcttctcatgctgccgagcaactcccacgcttgcaggcgttcaaaacggccaggaccattaaagtaaatcctgatgccccccagaaaagtgctcgcttcttcgtccttgaaagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccat

SEQ ID NO: 153189 - DNA, 2451 bp, Homo sapiens
  Payload ID: 10141
  Gene Symbol: MTHFSD
  Gene Name: methenyltetrahydrofolate synthetase domain containing
  ENST ID: ENST00000546093
  CDS Start-End: 611-1273
actacgcgccagaacctgcgccgggaagcgtcgcacagcgactgcatcaccatggagccgagggtgtctccaaacaggacatacgtgaacaaatttggggctacatggaatcacaaaatttagctgactttccccgacctgttcatcacaggatacccaactttaagggcgcttctcatgctgccgagcaactcccacgcttgcaggcgttcaaaacggccaggaccattaaagtaaatcctgatgccccccagaaaagtgctcgcttcttcgtccttgaaagcaaaaaaacattgttggttccaacaccacgactgagaacgggattgtttaataagatcacaccaccccctggggcaactaaagacatcttgagaaaatgtgccacctctcaggtgccaccagagcgactggggagacaggatagaatttccaaaacatgctccattggaaattgcctcaccagttctaaggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgcc

SEQ ID NO: 153190 - DNA, 1207 bp, Homo sapiens
  Payload ID: 10141
  Gene Symbol: MTHFSD
  Gene Name: methenyltetrahydrofolate synthetase domain containing
  Uniprot ID: Q2M296
  ENST ID: ENST00000543303
  CDS Start-End: 20-1168
gcacagcgactgcatcaccatggagccgagggcaggtgtctccaaacaggacatacgtgaacaaatttggggctacatggaatcacaaaatttagctgactttccccgacctgttcatcacaggatacccaactttaagggcgcttctcatgctgccgagcaactcccacgcttgcaggcgttcaaaacggccaggaccattaaagtaaatcctgatgccccccagaaaagtgctcgcttcttcgtccttgaaagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccat

SEQ ID NO: 153191 - DNA, 543 bp, Homo sapiens
  Payload ID: 10141
  Gene Symbol: MTHFSD
  Gene Name: methenyltetrahydrofolate synthetase domain containing
  ENST ID: ENST00000561522
  CDS Start-End: 494-543
actacgcgccagaacctgcgccgggaagcgtcgcacagcgactgcatcaccatggagccgagggcaggggtcttatctggcttgccaaaacatcaaagacctagacgtttttgccagaacacaggaagttaaagtggaccctgataaaccactggaaggcgttcggctgctggtgctgcaggtaattccacttccctgagccgagccgagacctggccgccaagggggacaccttttccagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccat

SEQ ID NO: 153192 - DNA, 556 bp, Homo sapiens
  Payload ID: 10141
  Gene Symbol: MTHFSD
  Gene Name: methenyltetrahydrofolate synthetase domain containing
  ENST ID: ENST00000567539
  CDS Start-End: 52-222
actacgcgccagaacctgcgccgggaagcgtcgcacagcgactgcatcaccatggagccgagggcaggtgtctccaaacaggacatacgtgaacaaatttggggctacatggaatcacaaaatttagctgactttccccgacctgttcatcacaggatacccaactttaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttgg

SEQ ID NO: 153193 - DNA, 573 bp, Homo sapiens
  Payload ID: 10141
  Gene Symbol: MTHFSD
  Gene Name: methenyltetrahydrofolate synthetase domain containing
  ENST ID: ENST00000569000
  CDS Start-End: 52-573
actacgcgccagaacctgcgccgggaagcgtcgcacagcgactgcatcaccatggagccgagggcaggtgtctccaaacaggacatacgtgaacaaatttggggctacatggaatcacaaaatttagctgactttccccgacctgttcatcacaggatacccaactttaagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccaca

SEQ ID NO: 153194 - DNA, 508 bp, Homo sapiens
  Payload ID: 10141
  Gene Symbol: MTHFSD
  Gene Name: methenyltetrahydrofolate synthetase domain containing
  ENST ID: ENST00000561989
  CDS Start-End: 173-508
ggtggggggcctggcggggctccggggcggctgggaatggggagggacagccgggaccggtgagggtcgaggcggggccaccggggctggcagaggatggggcagaatcaccggaagcggccgaggagtaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcaggtgccaccagagcgactggggagacaggatagaatttccaaaaca

SEQ ID NO: 153195 - DNA, 560 bp, Homo sapiens
  Payload ID: 10141
  Gene Symbol: MTHFSD
  Gene Name: methenyltetrahydrofolate synthetase domain containing
  ENST ID: ENST00000568798
  CDS Start-End: 52-372
actacgcgccagaacctgcgccgggaagcgtcgcacagcgactgcatcaccatggagccgagggcagtaggtgtctccaaacaggacatacgtgaacaaatttggggctacatggaatcacaaaatttagctgactttccccgacctgttcatcacaggatacccaactttaagagcaaaaaaacattgttggttccaacaccacgactgagaacgggattgtttaataagatcacaccaccccctggggcaactaaagacatcttgagaaaatgtgccacctctcaggtgccaccagagcgactggggagacaggatagaatttccaaaacatgctccattggaaattgcctcaccagttctaaggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccac

SEQ ID NO: 153196 - DNA, 824 bp, Homo sapiens
  Payload ID: 10141
  Gene Symbol: MTHFSD
  Gene Name: methenyltetrahydrofolate synthetase domain containing
  ENST ID: ENST00000566469
  CDS Start-End: 1-701
gtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaaggtgggtcacggcagtggccagctctggcctgtagcttagcggctcctcctcttttaagtgttttctgtctggcatgggagctgttggcaatcccagcatggctgtatgttagaatcacccaaggagcttttgagcaatttggctcctgaatgaccatgtcca

SEQ ID NO: 153197 - DNA, 565 bp, Homo sapiens
  Payload ID: 10141
  Gene Symbol: MTHFSD
  Gene Name: methenyltetrahydrofolate synthetase domain containing
  ENST ID: ENST00000562994
  CDS Start-End: 511-565
actacgcgccagaacctgcgccgggaagcgtcgcacagcgactgcatcaccatggagccgagggcaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcaggtgccaccagagcgactggggagacaggatagaatttccaaaacatgctccattggaaattgcctcaccagttctaaggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtcc

SEQ ID NO: 153198 - DNA, 1142 bp, Homo sapiens
  Payload ID: 10141
  Gene Symbol: MTHFSD
  Gene Name: methenyltetrahydrofolate synthetase domain containing
  ENST ID: ENST00000562940
  CDS Start-End: 1-672
ggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagattaggtaatggcacaggttgcaaattagtctgcagtaggagtttgaccctgcaaatcagcctgtaggttatgatgctgtctctgctggcaaacagccagaattactgagaagacatttgtgcttcgtgtggacaaaactactggtcaaataagcatacgtgtccacgtctcccattctttaatcccaaatcattcaccgtttgaatccctcctttgggcatggaaaattaacaacatcacctctaaggatgaacacagaatacctgctgcttttgccacagcccagccgggactttccctgcaggtgtcctgggcaggcactgctggggactcccaggtgtgcactcctcggttggccgctgatgaacgcagagggaacagcctttgtaacccagagtgtatgggcggccctctaagcgcaccaggagcactgggaaagaaggtggtcactgctcttccaggaaatgaaaatatccct

SEQ ID NO: 153199 - DNA, 1270 bp, Homo sapiens
  Payload ID: 10141
  Gene Symbol: MTHFSD
  Gene Name: methenyltetrahydrofolate synthetase domain containing
  ENST ID: ENST00000566050
  CDS Start-End: 20-274
gcacagcgactgcatcaccatggagccgagggcagtaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcaggtaattccacttccctgagccgagccgagacctggccgccaagggggacaccttttccagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccat

SEQ ID NO: 153200 - DNA, 581 bp, Homo sapiens
  Payload ID: 10141
  Gene Symbol: MTHFSD
  Gene Name: methenyltetrahydrofolate synthetase domain containing
  ENST ID: ENST00000565482
  CDS Start-End: 315-581
ggttcgggtcgaaccagcggctctctcgcccggaatcccgagaaagatgtcaggaaaaataaagataacgagaagacgaggcgggagggacacctgccgtgcacgtgggggagcccgtgggccccttgaggtcggggaaactgaggctcaggaacaggatcggaagccggtttgacctacacgcgggggtcgcttaactactgttaagcggtttcagcatgggctctggaattcctttgtatgttattaagtgggaatcttttgttgcagtaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatc

SEQ ID NO: 153201 - DNA, 493 bp, Homo sapiens
  Payload ID: 10141
  Gene Symbol: MTHFSD
  Gene Name: methenyltetrahydrofolate synthetase domain containing
  ENST ID: ENST00000564364
  CDS Start-End: 158-493
ggggctccggggcggctgggaatggggagggacagccgggaccggtgagggtcgaggcggggccaccggggctggcagaggatggggcagaatcaccggaagcggccgaggagtaggtgtctccaaacaggacatacgtgaacaaatttggggctacatggaatcacaaaatttagctgactttccccgacctgttcatcacaggatacccaactttaagggcgcttctcatgctgccgagcaactcccacgcttgcaggcgttcaaaacggccaggaccattaaagtaaatcctgatgccccccagaaaagtgctcgcttcttcgtccttgaaagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtc

SEQ ID NO: 153202 - DNA, 845 bp, Homo sapiens
  Payload ID: 10141
  Gene Symbol: MTHFSD
  Gene Name: methenyltetrahydrofolate synthetase domain containing
  ENST ID: ENST00000568037
  CDS Start-End: 1-459
ccgagggcagtaggtgtctccaaacaggacatacgtgaacaaatttggggctacatggaatcacaaaatttagctgactttccccgacctgttcatcacaggatacccaactttaagggcgcttctcatgctgccgagcaactcccacgcttgcaggcgttcaaaacggccaggaccattaaagtaaatcctgatgccccccagaaaagtgctcgcttcttcgtccttgaaagcaaaaaaacattgttggttccaacaccacgactgagaacgggattgtttaataagatcacaccaccccctggggcaactaaagacatcttgagaaaatgtgccacctctcaggtgccaccagagcgactggggagacaggatagaatttccaaaacatgctccattggaaattgcctcaccagttctaattggtcagtgcctgcccccgtggaccctgcgagatgatgagaacacagggtttcctgcagtgcagggtttcctggactaagcccccttctgtgactgtcgggagacccccaagccacccgtatgcactgatccatacggaacttgtcatagcactgcaggcagatcccaccgccacatcgaatgatcagttactgctggatacgggactgaaaatggctttttcctgagtcttacataaaccgtgttatgagaaccatgaacatattcagcttccctattctttatatgcatgcctgcattagtataaagcggtacacttttgggacattttggttgaagggataattttttagaagcgagtatattgtacataaagatagtggccttcaggattttatattgaataaatatgtcatacagtg

SEQ ID NO: 153203 - DNA, 1207 bp, Homo sapiens
  Payload ID: 10141
  Gene Symbol: MTHFSD
  Gene Name: methenyltetrahydrofolate synthetase domain containing
  ENST ID: ENST00000634347
  CDS Start-End: 20-1168
gcacagcgactgcatcaccatggagccgagggcaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctccccggggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccat

SEQ ID NO: 153204 - DNA, 3410 bp, Homo sapiens
  Payload ID: 10142
  Gene Symbol: MAT1A
  Gene Name: methionine adenosyltransferase I, alpha
  Uniprot ID: Q00266
  ENST ID: ENST00000372213
  CDS Start-End: 262-1449
atataggagtcgctcaggagcaagctgtggcaagctggagggagggacacatcccgtgttccatccactccctcccttctcagcagtcctcgcctgttctcacgtgctcacaggcagttaggcagaagtgatccccgtggctctgccaaagacaagcctgttgggttgaaagaagaagaagaagaagaaaaaaaaactcaggcaaagtcacagcctcaaaattgttcactgaaagaagcgtgagtggagaagtgtgagaagatgaatggaccggtggatggcttgtgtgaccactctctaagtgaaggagtcttcatgttcacatcggagtctgtgggagagggacacccggataagatctgtgaccagatcagtgatgcagtgctggatgcccatctcaagcaagaccccaatgccaaggtggcctgtgagacagtgtgcaagaccggcatggtgctgctgtgtggtgagatcacctcaatggccatggtggactaccagcgggtggtgagggacaccatcaagcacatcggctacgatgactcagccaagggctttgacttcaagacttgcaacgtgctggtggctttggagcagcaatccccagatattgcccagtgcgtccatctggacagaaatgaggaggatgtgggggcaggagatcagggtttgatgttcggctatgctaccgacgagacagaggagtgcatgcccctcaccatcatccttgctcacaagctcaacgcccggatggcagacctcaggcgctccggcctcctcccctggctgcggcctgactctaagactcaggtgacagttcagtacatgcaggacaatggcgcagtcatccctgtgcgcatccacaccatcgtcatctctgtgcagcacaacgaagacatcacgctggaggagatgcgcagggccctgaaggagcaagtcatcagggccgtggtgccggccaagtacctggacgaagacaccgtctaccacctgcagcccagtgggcggtttgtcatcggaggtccccagggggatgcgggtgtcactggccgtaagattattgtggacacctatggcggctggggggctcatggtggtggggccttctctgggaaggactacaccaaggtagaccgctcagctgcatatgctgcccgctgggtggccaagtctctggtgaaagcagggctctgccggagagtgcttgtccaggtttcctatgccattggtgtggccgagccgctgtccatttccatcttcacctacggaacctctcagaagacagagcgagagctgctggatgtggtgcataagaacttcgacctccggccgggcgtcattgtcagggatttggacttgaagaagcccatctaccagaagacagcatgctacggccatttcggaagaagcgagttcccatgggaggttcccaggaagcttgtattttagagccagggggagctgggcctggtctcaccctggaggcacctggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgtaaggatgggcatggtgttctcctgctgctccctcagactggggcaatgttaatttagtggaaaaggcacccccgtcaagagtgaattccctcactcgtctcccccaacagctggaccctgaccagctccccctccctccccttgcctgtgccaggtgaggtcagcacatctcaacaggcctcagggctccttgtgggcctgggctcctggacccccctttcacaggcagccagtgccctgagccagggtctccagaaagccccacccaggccaggcatgtggcaggggttagagcaggactgatgtctcctaagcacctgtaatgtgcgagggacccagctaataactgatctcgttttttcttcactgcaacatgatgaggtagtaccttttatatcccatttatagatgggggaaagcaaagcacagagagtctggataacttccacagggtcccacagccacgtgtttagacctagatgtataactaggagctttgactcaggagcctgtgacataccccctcccccaccgttgtctcatgccagtaacaggctcaaacaatgacaaagcagattcagaaatgaggccatggactctgtcctgaaggcctgaggttactggaaattaggggattaacccactagctcttgttgagccgtgggcaattgtctgaaaagtgaagacagaaccacagggctattttgtttgcttcatgtgtcccagaagatgactgagggtgagttggcttacctggcccatcagggtaggctggagttagggactgaccagcagctttagaatcccagccccctgaccactcagagacatgcagagattgggtttttggacttctggggtaagtggtctaagtccagtccagtcctatctgggcttcctggagcagaagcagcaacttgtcctagcacagatggccagccccttagacagaggccctcaagtctttctctttccctggtcccttgtatcccctgcaggctgagtgcatttggagggagtgagtggccctttcggatccagggaggctggtcctatggcctcatgttaaataggcggggcttgccttctggtgttggacaagcttctgagacgtcatgaggagattctgcctttgccaggtgactgtctggggagcgggtctgctcccaaggggcctgagcagtccttggcctgctaaggtcttggaacttgcctgcctttccatccatggccagcagcacctgccctacctgccccacttgtccttagcctggacctctgacagcagcatctctaccttctccccagctcccaggaccacaggctcaggcaggggcctccatgggccccaggggaacactggggacttggcctctctctagggtacatggtgctgggagaggcagcccaggaagtctcatctggggagcaggcagccagcatctgggccttggcctggagcacaaagaccctggctttcattttctctcaggtgaaaggaaattaaggcaacaaaagaagcccggctcctggtcacctaggaagcctcagattccttcccatggagggagggagtggtttgcaggtggccaagttcctctaacttggctcacactcgacatgaaaattcagaattttatactttccctaccctctagagaaataagatcttttttgtcagtttgtttgtatgaaactaaagcctttatttgttaatagttcctgctaaaacaatgaataaaaactcaaggagcaacta

SEQ ID NO: 153205 - DNA, 435 bp, Homo sapiens
  Payload ID: 10142
  Gene Symbol: MAT1A
  Gene Name: methionine adenosyltransferase I, alpha
  ENST ID: ENST00000455001
  CDS Start-End: 1-435
gagtctgtgggagagggacacccggataagatctgtgaccagatcagtgatgcagtgctggatgcccatctcaagcaagaccccaatgccaaggtggcctgtggctttgacttcaagacttgcaacgtgctggtggctttggagcagcaatccccagatattgcccagtgcgtccatctggacagaaatgaggaggatgtgggggcaggagatcagggtttgatgttcggctatgctaccgacgagacagaggagtgcatgcccctcaccatcatccttgctcacaagctcaacgcccggatggcagacctcaggcgctccggcctcctcccctggctgcggcctgactctaagactcaggtgacagttcagtacatgcaggacaatggcgcagtcatccctgtgcgcatccacaccatcgtcatctctgtgcag

SEQ ID NO: 153206 - DNA, 2819 bp, Homo sapiens
  Payload ID: 10143
  Gene Symbol: MAT2A
  Gene Name: methionine adenosyltransferase II, alpha
  Uniprot ID: P31153
  ENST ID: ENST00000306434
  CDS Start-End: 124-1311
ttcgttcgctccgcgccgcccgcctgctacgagtagaacgctgtccgcagcttgcgcatttcgcagccgctgccgcctcgccgctgctccttcgtaaggccacttccgcacaccgacaccaacatgaacggacagctcaacggcttccacgaggcgttcatcgaggagggcacattccttttcacctcagagtcggtcggggaaggccacccagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgctcttaattgccacctctaacagcaccaaatcaaaatctctccactttcagctgtcttttggaggacgtacgtaataaggttttaatttagtaaaccaatcctatgcatggtttcagcactagccaaacctcaccaactcctagttctagaaaaacaggcacttggcagccttgtgatgtcatacagagaagtcacagggcagtacctgagggtctgtaggttgcacactttggtaccagataacttttttttttctttataagaaagcctgagtactccacactgcacaataactcctcccagggttttaactttgttttattttcaaaaccaggtccaatgagctttctgaacagctggtgtagctacagagaaaccagcttccttcagagagcagtgcttttggcggggaggaggaaatcccttcatacttgaacgttttctaattgcttatttattgtattctggggtatggcgtaagtacagagaagccatcacctcagatggcagcttttaaaagattttttttttttctctcaacaccatgattcctttaacaacatgtttccagcattcccaggtaggccaaggtgtcctacagaaaaaccttgggttagacctacagggggtctggctggtgttaacagaagggagggcagagctggtgcggctggccatggagaaagctgacttggctggtgtggtacagagaagccagcttgtttacatgcttattccatgactgcttgccctaagcagaaagtgcctttcaggatctatttttggaggtttattacgtatgtctggttctcaattccaacagtttaatgaagatctaaataaaatgctaggttctaccttaa

SEQ ID NO: 153207 - DNA, 1927 bp, Homo sapiens
  Payload ID: 10143
  Gene Symbol: MAT2A
  Gene Name: methionine adenosyltransferase II, alpha
  Uniprot ID: P31153
  ENST ID: ENST00000409017
  CDS Start-End: 458-1357
aaaacgtgaagggcgggggctgtggtcgctagtgagttctggccgggaagggagggcactgttaacccctcccggccctgccgtctgacaaacctggagtgggcgacccgccccgcgtgctcgcgtccggccctcgggagcgcgcgccccgcattgcagcggcgaccacgtgtttgccgcatgtggtatctgggcgagggggagccgtgagcctccccggctgtcctggccctcagtttgaggggtggggggcctatgccttgggacgtcgtctggctccactgcctcagtggttaggtcttgactacacactggagaatacgcacatgcccttcggcggatatggccttgcctccaagataagatttgtgaccaaatcagtgatgctgtccttgatgcccaccttcagcaggatcctgatgccaaagtagcttgtgaaactgttgctaaaactggaatgatccttcttgctggggaaattacatccagagctgctgttgactaccagaaagtggttcgtgaagctgttaaacacattggatatgatgattcttccaaaggttttgactacaagacttgtaacgtgctggtagccttggagcaacagtcaccagatattgctcaaggtgttcatcttgacagaaatgaagaagacattggtgctggagaccagggcttaatgtttggctatgccactgatgaaactgaggagtgtatgcctttaaccattgtcttggcacacaagctaaatgccaaactggcagaactacgccgtaatggcactttgccttggttacgccctgattctaaaactcaagttactgtgcagtatatgcaggatcgaggtgctgtgcttcccatcagagtccacacaattgttatatctgttcagcatgatgaagaggtttgtcttgatgaaatgagggatgccctaaaggagaaagtcatcaaagcagttgtgcctgcgaaataccttgatgaggatacaatctaccacctacagccaagtggcagatttgttattggtgggcctcagggtgatgctggtttgactggacgcaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtctcttatgctattggagtttctcatccattatctatctccattttccattatggtacctctcagaagagtgagagagagctattagagattgtgaagaagaatttcgatctccgccctggggtcattgtcaggtaaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgct

SEQ ID NO: 153208 - DNA, 2226 bp, Homo sapiens
  Payload ID: 10144
  Gene Symbol: MAT2B
  Gene Name: methionine adenosyltransferase II, beta
  Uniprot ID: Q9NZL9
  ENST ID: ENST00000280969
  CDS Start-End: 282-1253
gcaaatagacccaggcttgactggcaattaaacatgaaacttctcattgggtattttcgagactactacggggaatcagctaccagcttactgccatgtggagaactgcacgagattccgggattggaatcaaaatgctaatttaaaaggtcaagtgaagctgctcctcacgttttggcgtgcctgcgctctctgcaggcagaagcgaacaaagacccagcaagagaaggcagaggctaagacccatcccgtatctgctctcctgaaataattctggagtcatgcctgaaatgccagaggacatggagcaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacacttgatccagaa

SEQ ID NO: 153209 - DNA, 2103 bp, Homo sapiens
  Payload ID: 10144
  Gene Symbol: MAT2B
  Gene Name: methionine adenosyltransferase II, beta
  Uniprot ID: Q9NZL9
  ENST ID: ENST00000321757
  CDS Start-End: 140-1144
gcagcggaagccggaagcggcgagcggggtcgttctgggcctaggggaggcgggccgagggcgtctgagctgaggcccgcgtcgatcctgggttggaggaggtggcggccgctgaggctgcggcgtgaagacggcgggcatggtggggcgggagaaagagctctctatacactttgttcccgggagctgtcggctggtggaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaa

SEQ ID NO: 153210 - DNA, 698 bp, Homo sapiens
  Payload ID: 10144
  Gene Symbol: MAT2B
  Gene Name: methionine adenosyltransferase II, beta
  ENST ID: ENST00000421814
  CDS Start-End: 104-698
gggcctaggggaggcgggccgagggcgtctgagctgaggcccgcgtcgatcctgggttggaggaggtggcggccgctgaggctgcggcgtgaagacggcgggcatggtggggcgggagaaagagctctctatacactttgttcccgggagctgtcggctggtggagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtg

SEQ ID NO: 153211 - DNA, 3409 bp, Homo sapiens
  Payload ID: 10144
  Gene Symbol: MAT2B
  Gene Name: methionine adenosyltransferase II, beta
  Uniprot ID: Q9NZL9
  ENST ID: ENST00000518095
  CDS Start-End: 74-853
gagctgaggcccgcgtcgatcctgggttggaggaggtggcggccgctgaggctgcggcgtgaagacggcgggcatggtggggcgggagaaagagctctctatacactttgttcccgggagctgtcggctggtggaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggtaagaaggattcctgagtcctgtcttagcgaaggtccgctttgtcttttccatgcttgaactttcacagctgtacttggagtgttactgagtgaaagccaaaagtgcttttttaaaactaggagaccaaacaaaagtagtttacatatacactgtattcatgaagaataaaaatattatgctcttctgtttgaatttatttcttatgtactatagatcccatcatttcttttattgcaaagtgttaggaaacttcaaaataatcatctaaggtcttttaagaagatactctttgggggctgggcgtgatggctcacacctgtaatcccagcacatttgaaaaagttggtattaaatataatatccatacaaagaaagatgagactgatttagtttagaatattaataggatgaccacagttttttaatatatgagaattatattttgtaatatataacatgacaatatttaagaaagtttagctcaacttgaaaaatggttctattaagtttttgttgtagcttgggataattaaaaatactcattaaattgtactgttttcataaaaatttgtaatgcttttttatattcccactaattaagtaaaattggagcctttttttgattttaaaaattcttaaggtttaaattctagaaattgctcttttaagtgttttgctaagagtattagtaggaatttgattttagatatcttgtggagacctttccagaaaaagagggttgccttttagttcctggaccttattttaagtaagctttttggtcaaacctattctactcagctcaaaaagttgaaactattgaatttattgtgtcatcgttcttaggatccatcaattaagggaacctttcactggtctggcaatgaacagatgactaagtatgaaatggcatgtgcaattgcagatgccttcaacctccccagcagtcacttaagacctgtaagtacatggctgtaaaaacctttagatccattgctatggtatatattattgctgtgttgggtaacttcatttctcagtactaatcaaagtgaactttgcttgtatgctggctgttcatagtgctacttttctctaaattatcatctgtagagaagatcatgagtattgaagtttgtagaaaatgtattattgtcttgatcatgacaggcatttggtttatttttccagggatgatcaaatcagatttcttacactaagagcaaaaataagtagcaaatataaaacctcaaaatggccaggcacaatggctcatgcctgtaatcccaacactttgggaggctgacgcaggaggatcccttgagcccaggaatttgagactagcctgggcaatggagggagatctcatctctgtttaaaaatatatacatatttaaaaaaaggtcagggggaacaaagccctcaaaatatagcctttcacttacttttgatttttttgtgtttatctttctttaaagattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacactt

SEQ ID NO: 153212 - DNA, 557 bp, Homo sapiens
  Payload ID: 10144
  Gene Symbol: MAT2B
  Gene Name: methionine adenosyltransferase II, beta
  ENST ID: ENST00000520449
  CDS Start-End: 49-402
gttggaggaggtggcggccgctgaggctgcggcgtgaagacggcgggcatggtggggcgggagaaagagctctctatacactttgttcccgggagctgtcggctggtggaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaac

SEQ ID NO: 153213 - DNA, 1536 bp, Homo sapiens
  Payload ID: 10145
  Gene Symbol: MSRA
  Gene Name: methionine sulfoxide reductase A
  Uniprot ID: Q9UJ68
  ENST ID: ENST00000317173
  CDS Start-End: 250-957
ggaactcgccgggccacaccccctgtccagggaaggaacacgcccccggtgacagccggtacggccccgggtttgggcaacctcgattacgggcggcctccagccccgccagcagcgccccgcgcccgcccgcccgcgcccctgccgccccccggttccggccgcggaccccactctctgccgttccggctgcggctccgctgccggtagcgccgtcccccgggaccacccttcggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcggccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataatttctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcagtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataaggggctttctctcccttttcagccctctctgtgcagagaaaagatgtgagtccgcttgatgaattctaatgctttgcttagagctatgagaaatgtttgttttaataaaaacctacagtccaataatgccaa

SEQ ID NO: 153214 - DNA, 1460 bp, Homo sapiens
  Payload ID: 10145
  Gene Symbol: MSRA
  Gene Name: methionine sulfoxide reductase A
  Uniprot ID: Q9UJ68
  ENST ID: ENST00000382490
  CDS Start-End: 305-883
aaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaacccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataatttctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcagtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataaggggctttctctcccttttcagccctctctgtgcagagaaaagatgtgagtccgcttgatgaattctaatgctttgcttagagctatgagaaatgtttgttttaataaaaacctacagtccaataatgcc

SEQ ID NO: 153215 - DNA, 788 bp, Homo sapiens
  Payload ID: 10145
  Gene Symbol: MSRA
  Gene Name: methionine sulfoxide reductase A
  Uniprot ID: Q9UJ68
  ENST ID: ENST00000441698
  CDS Start-End: 148-735
gccccgccagcagcgccccgcgcccgcccgcccgcgcccctgccgccccccggttccggccgcggaccccactctctgccgttccggctgcggctccgctgccggtagcgccgtcccccgggaccacccttcggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcggccaaacatcatgtcaatggcaacagaacagtcgaacctttcccagagggaacacagatggctgtatttgaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataatttctccccacatggtgggcctttgaggttccagtaaaaatgctttcaacaaa

SEQ ID NO: 153216 - DNA, 559 bp, Homo sapiens
  Payload ID: 10145
  Gene Symbol: MSRA
  Gene Name: methionine sulfoxide reductase A
  ENST ID: ENST00000521686
  CDS Start-End: 1-274
aaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggtacccaagcatgttcactggaagaagagaacacagactgggctgcagacggagggaagatgagtatagggactctccttgtctgtccctgtacctgcccactgccacctgtctacgtcctgagatacccagcagaggacagggttccacttggaaaattcttttgaatctcacacaagacagtaataaacatagagggagaaataacaagacattttaccatgtcttgtgtcatgtaggaaactttacatttcagaaaatatgaagacaaaaagatgaaggaaagggctttaaggatacaaaggaccttattatggaaggaaagcagtgttgtcaagagagctaaaa

SEQ ID NO: 153217 - DNA, 871 bp, Homo sapiens
  Payload ID: 10145
  Gene Symbol: MSRA
  Gene Name: methionine sulfoxide reductase A
  ENST ID: ENST00000522907
  CDS Start-End: 625-871
agagtgagagagagaaagagggagagagagaggcagagggagagctgaggaaagaaaaaaaggcaagacttggcacagctcagtcaaatcagcttcttttgtctgctttctcggcttgagcttcaggaaagaaaaccgtcctggggtacagaaaaactcagaactttttggttttcaaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaaccaattagtgacaacactgaagaccagaaaggcaagctgaagacaccagacttcgcttgaagggcaaacaagaaatccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgcc

SEQ ID NO: 153218 - DNA, 674 bp, Homo sapiens
  Payload ID: 10145
  Gene Symbol: MSRA
  Gene Name: methionine sulfoxide reductase A
  ENST ID: ENST00000518255
  CDS Start-End: 17-658
cggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcggccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaagctggtgcttccctgttcttcctcagccatgctggggctcactgcagcctcctctgctcaactcgcctgggtgcagccatcttcaagaaaacattattaaagcaatattattagta

SEQ ID NO: 153219 - DNA, 814 bp, Homo sapiens
  Payload ID: 10145
  Gene Symbol: MSRA
  Gene Name: methionine sulfoxide reductase A
  ENST ID: ENST00000521209
  CDS Start-End: 187-366
tgaatgatagattattattttacattgtaggtacagccagtgtgatcagacaaagcaattcgagaactacaaaagaggaaaaaagatcagaagttcttaaatacataagggaatgcagcatttgataaagccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagatgttcagaacaattccatgtttattagtctattcaaaagcttttagaaatctgcacagccaagtggcactgaatccagaagcatgaaaggagctgcacaacttttcctcgtaagatttacacaagcagcacgggaaatctgaggcccagacatttccttatcaacagaatactccggtggattttcaagcaggctgttcagcagaggtttcgagcaggagcccaggtgtgggaagagcggagtgtgggagtcctcgtgtgaccctctgggggtggtgatggaactgactgtatggtctgcaaaacctaaaatatttactgtcaggtgcttatgtgtcctgtcctgagcccgtttcctctcttgtaaaatggggcaatgctgcttgatgaaaccagtcaagttgtggttggattcttatatgtaataaacctgcacattgtgcacatataccctaaaacttaaagtatgataaaaataaaaaaaattgttgcaaa

SEQ ID NO: 153220 - DNA, 1706 bp, Homo sapiens
  Payload ID: 10145
  Gene Symbol: MSRA
  Gene Name: methionine sulfoxide reductase A
  Uniprot ID: Q9UJ68
  ENST ID: ENST00000528246
  CDS Start-End: 624-1133
gagtgagagagagaaagagggagagagagaggcagagggagagctgaggaaagaaaaaaaggcaagacttggcacagctcagtcaaatcagcttcttttgtctgctttctcggcttgagcttcaggaaagaaaaccgtcctggggtacagaaaaactcagaactttttggttttcaaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaaccaattagtgacaacactgaagaccagaaaggcaagctgaagacaccagacttcgcttgaagggcaaacaagaaatccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataatttctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcagtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataaggggctttctctcccttttcagccctctctgtgcagagaaaagatgtgagtccgcttgatgaattctaatgctttgcttagagctatgagaaatgtttgttttaataaaaacctacagtccaataa

SEQ ID NO: 153221 - DNA, 1423 bp, Homo sapiens
  Payload ID: 10146
  Gene Symbol: MSRB1
  Gene Name: methionine sulfoxide reductase B1
  Uniprot ID: Q9NZV6
  ENST ID: ENST00000361871
  CDS Start-End: 171-521
cagccctgaggaggggcggggcctcccggaggcggaagccgggattcgccctccggggagcgattggtcctcgggaggggcggggaggtggacgcgggtaccggcggtcgtcgggtcggcagcctttggtcagttggcagcggcaagcgcgctgcggttccggtggcgccatgtcgttctgcagcttcttcgggggcgaggttttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcccagggtcactaggcgggcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttggaaaagagactcatttgctgatggttcatgccttctgctgggacaggcctgggctgtgcagccacactgtcggctgacttagccccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcagatgtactgtctttttttttgtttt

SEQ ID NO: 153222 - DNA, 847 bp, Homo sapiens
  Payload ID: 10146
  Gene Symbol: MSRB1
  Gene Name: methionine sulfoxide reductase B1
  ENST ID: ENST00000399753
  CDS Start-End: 40-720
agttggcagcggcaagcgcgctgcggttccggtggcgccatgtcgttctgcagcttcttcgggggcgaggttttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgagaggccacaggggtgggggagggacgggggcggccagggagagcagagagccagtcccaccttcctccctctgcttgccccacagctccaggggcttagaggcgtctattccaggcctgttgcctctgccagggagctgccaccccaggctatcgggagagcctggccttctggtgcaaatgtgggaaacaggacaggtttcctgtacgggctccaggacaaaggtcaacctcttatgtcggcggtcagcttgggaaataggcgtgtgggaagaaacaccatctgccagccccagtaagggccttcactgtggctgtatcatggccagaagctcacccagctgccttgtgatctttccaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcccagggtcactaggcgggcagcccacacccaccccagacggccaccacactgaggccacacgttggccattccaccttggagttggaaccctgggcgtcgagacag

SEQ ID NO: 153223 - DNA, 550 bp, Homo sapiens
  Payload ID: 10146
  Gene Symbol: MSRB1
  Gene Name: methionine sulfoxide reductase B1
  ENST ID: ENST00000564908
  CDS Start-End: 44-499
ggtcagttggcagcggcaagcgcgctgcggttccggtggcgccatgtcgttctgcagcttcttcgggggcgaggttttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaagctccaggggcttagaggcgtctattccaggcctgttgcctctgccagggagctgccaccccaggctatcgggagagcctggccttctggtgcaaatgtgggaaacaggacaggtttcctgtacgggctccaggacaaaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcccagggtcactaggcgggcagcccacaccc

SEQ ID NO: 153224 - DNA, 373 bp, Homo sapiens
  Payload ID: 10146
  Gene Symbol: MSRB1
  Gene Name: methionine sulfoxide reductase B1
  ENST ID: ENST00000473663
  CDS Start-End: 1-169
ttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggcaaagaaacttctgcctcccagggtcactaggcgggcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttgg

SEQ ID NO: 153225 - DNA, 1363 bp, Homo sapiens
  Payload ID: 10146
  Gene Symbol: MSRB1
  Gene Name: methionine sulfoxide reductase B1
  ENST ID: ENST00000622125
  CDS Start-End: 138-485
ggaagccgggattcgccctccggggagcgattggtcctcgggaggggcggggaggtggacgcgggtaccggcggtcgtcgggtcggcagcctttggtcagttggcagcggcaagcgcgctgcggttccggtggcgccatgtcgttctgcagcttcttcgggggcgaggttttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgtcctgtggcaagtgtggcaatgggttgggccacgagttcctgaacgacggccccaagccggggcagtcccgattcatattcagcagctcgctgaagtttgtccctaaaggcaaagaaacttctgcctcccagggtcactaggcgggcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttggaaaagagactcatttgctgatggttcatgccttctgctgggacaggcctgggctgtgcagccacactgtcggctgacttagccccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcag

SEQ ID NO: 153226 - DNA, 1803 bp, Homo sapiens
  Payload ID: 10147
  Gene Symbol: MSRB2
  Gene Name: methionine sulfoxide reductase B2
  Uniprot ID: Q9Y3D2
  ENST ID: ENST00000376510
  CDS Start-End: 104-652
cgactagcgcaggcggacgggagagaatgggggaggggtgggatgggagcaggggcagagacgggcagagggcagagggcggagcggcgccggagcgggcgtcatggcgcggctcctctggttgctccggggcctgaccctcggaactgcgcctcggcgggcggtgcggggccaagcgggcggcggcgggcccggcaccgggccgggactgggggaggcagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactgaccatcttcaagagtcccgttcccttgccaccccttcacgtgcaccctcaatttccacaattcacttgaatgacttgttttatttgcaataaaactgggctgaatttgctgctgtctccagcgagtcattgcttctcttaatttatttacctggaatcaacttaatcctgtgtgttaggctgttcttgtgttgctataaagaagtacctgatcaggatctgggagaatttgaaaaaaaaagaaaaactagaaaaataaacaaaattaaaaagaaaaaaaaatacctgagactgagtaacttataaagaaaagaggtttaattgactcacagttctgcagggtgtacagaaagcatggtgccagcatttgctcggattctggggagacctgagggagcttttactcatggcagaaggtgaagggggagccggcgtctcacatggcaaagcaggagcaagagagagtggtagggaggtgccacatacttttaaacagccagatctctcaagaactcactcactgtcaccaggacagcaccaagccatgagggatccaccctcatgacccagttacctcccggcagggcccacctccggcactaggaattatacttcaacataagatttggagagggaaaacatccaaaccatatcacccaactcccacttggagtagaacttcacaaaacgacagagggacagctgtttccatcaaacacttccacagcttcacctgagacgagggcatgactctgggaacatcaggaggctgatggactattaagccaaacaattcctacaaaaattccctgcaccttccactgcgtttcagtccttgacagacataagtaagggatcaagtgagaagaggaaggaaaatacaggatccaaggaatcaacaatgctagcactgaagagcaggattacggaggagctgtgctctgggagcatatatggtgatcaatcagatgcatgacttttttttcaaaattttaaatgtcttgagcatgctacttccaaccattctacccacaaataaactgcaataggacttggttagatttcaatgattatgaataaatgttcaccttcataccttctggttacaaagctaaactttaaaatgtccaaataaaatattcactaaaattta

SEQ ID NO: 153227 - DNA, 612 bp, Homo sapiens
  Payload ID: 10147
  Gene Symbol: MSRB2
  Gene Name: methionine sulfoxide reductase B2
  ENST ID: ENST00000472663
  CDS Start-End: 1-362
ggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagatccttgttggatatccagaaagaagtctttagcatcaaaggatcaagaagtccttccacttcgagaggcaatggcttcgatagtgaagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactgaccatcttcaagagtcccgttcccttgccaccccttcacgtgcaccctcaatttccacaattcacttgaatgacttgttttatttgcaataaa

SEQ ID NO: 153228 - DNA, 4417 bp, Homo sapiens
  Payload ID: 10148
  Gene Symbol: MSRB3
  Gene Name: methionine sulfoxide reductase B3
  Uniprot ID: Q8IXL7
  ENST ID: ENST00000308259
  CDS Start-End: 275-832
atatttggactcggctgcccgtgcccaggaatttcccgtcatgcctcccgccgccccgtccgtcgcccggagccggggagggagggagcgaggttcggacaccggcggcggctgcctggcctttccatgagcccgcggcggaccctcccgcgccccctctcgctctgcctctccctctgcctctgcctctgcctggccgcggctctgggaagtgcgcagtccgctcttgcccctgttctttgcttctcgttttgttggtgaagatatcacagtgatgtctgcattcaacctgctgcatttggtgacaaagagccagccagtagcccttcgagcctgtgggcttccctcagggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagtgtggtgctcaccttgggcacatttttgatgatgggcctcgtccaactgggaaaagatactgcataaattcggctgccttgtcttttacacctgcggatagcagtggcaccgccgagggaggcagtggggtcgccagcccggcccaggcagacaaagcggagctctagagtaatggagagtgatggaaacaaagtgtacttaatgcacagcttattaaaaaaatcaaaattgttatcttaatagatatattttttcaaaaactataagggcagttttgtgctattgatattttttcttcttttgcttaaacagaagccctggccatccatgtattttgcaattgactagatcaagaactgtttatagctttagcaaatggagacagctttgtgaaacttcttcacaagccacttataccctttggcattcttttctttgagcacatggcttcttttgcagtttttccccctttgattcagaagcagagggttcatggtcttcaaacatgaaaatagagatctcctctgcagtgtagagaccagagctgggcagtgcagggcatggagacctgcaagacacatggccttgaggcctttgcacagacccacctaagataaggttggagtgatgttttaatgagactgttcagctttgtggaaagtttgagctaaggtcatttttttttttctcactgaaagggtgtgaaggtctaaagtctttccttatgttaaattgttgccagatccaaaggggcatactgagtgttgtggcagagaagtaaacattaccacactgttaggcctttattttattttattttccatcgaaagcattggaggcccagtgcaatggctcacgcctgtgatcccagcactttgggaggccaaggcgggtggatcacgaggtcaggagatggagaccatcctggctaacatggtgaaaccccgtctctactaaaaatacgaaaaattagccaggcgtggtggtgggcacctgtagtcccagctactcaggaggctgaggcaggagaatggcgtgaacccggaaggcggagcttgcagttagccgagatcatgccactgcactccagcctacatgacaatgtgacactccatctcaaaaaataataataataacaatataagaactagctgggcatggtggcgcatgcatgtagtcccagctactcctgaggctcagtcaggagaatcgcttgaacttgggaggcggaggttgcagtgagctgagctcataccactgcactccagcctgaacagagtgagatcctgtcaaaaaagaaaagaaaaagaaagcagcattcaaatgtaagacaactgtaaaatattgagccccacttggtctaaaattcaaaaagaagaacgcctgtccatcgcctttttataagtccttctctccacacctaaaagcagctgcagctggaagggcacaaattccactgtgtaaaataaaatattaggggcaacacacttcatcaaggcagcaggaatgagagagagcagagaagatcaaggatgaagtcttgggtactgaaaaattcagtgctgggcagaaaaactgacagggcagtacaagtaacaaacagaatccaagtggggtggcccttgtgcacagagctccaggtgacctctggagagacatgggcattcacatggaaagctaaaacggaagctcaagtttcatactcaacataatcttctgtgtgacaaaggacaagccatgtagcctctctgtgcctatttcttcatgcataaactgggactcataatatttgtaaaatgtattgatactctcagggcaaattcactatattgctatacagttgagatcagtgttgtaaaattaaactgatctggttctaattgcctcaaaggccaaagcccaggcatttgaaatggaaagaagcagagaggaggctgacttagctgattggtatggaaacagttgggccaagagccagaatttccctttgtagcaacacggctagttttactttgagaagctctgctcagctgctttataacattaagtctggcggaatggatgtcactgtgcacaataaagttttcacaagtataaacaatggtgatgtaagtcaacattgctgtagccaggtgtgaaggttgtatggtgtgtgacgaatgtacatcatgtttgtaggtttggatgctaatcttgaattgtagtttaaaaaatacgtatttttgtaactctttgaaagtttatgaagactgacagctttccttgtaagcactaagagaaaaaaaagaaagagggacatttgacaattttaaagaaacaacaagaaattagaatgaaaatctgtgacaaacagcgtcagtgtggccatgtccacattcctacatgtctctctctacaagcacctctctaagaagcctgacatcccggtggactctttatagtcatgtacacttgattccagatgagctctggtcttatctggatgctcagataagaggtttctatctgagcatccagatgttccctcaggttccaagacatttcaccccaggccctgggttcactctggaattcgtaggcttcacgtctctctagaaatgacgtgtaaaatttaagaccagacctcagccatcagcgtccagaccatcctagaagtctttcccaatctcacagagaaagccctagtatttcccagtgaccccaggattccacgttggggtggccaaagaaataggtctctcagggctttgccacagcctccagcccatccttcagaggcacacacagcacctctcggctgctccagctctgtaggatagcctcccctggggtccgtgggacgcgggccacagtgttgaggtagacaaggaggatcagtgagaggcctcttccctctccacagagactggattgtcattgttccttcatttatatcgtagggcttaacatttcactcaaaaaaaagcccctctttttctaatccttagtctttgtttcaaggaaagccagtttttcttctaccacattttccaggatcgactttaagaaaaatgcaacatctattgaaaaaaagtggggtgtatgcatgtggtttaattccagattgcttttgggtttaagtggtatcaaatttcagtatatttctgtcttatgtgaaagaaatatattactaaaacgtcagtgagcaataatgtcagctgtcaagcactagatttatttttgcaggatatggagtgcaatgaactgagtcaatatggcaaggtgtatgtgatctgtgggagttatgccatttaacataggaagtgcatgggactttccctctctgcactccagctcttactgtaccattagaagatgcagaattctgttggtgtgcaaaaagtatagccttacattcaagcagaatggatctgaagaaagcagcaatatctgttactagagaacattcccatgtgtttaaactcttcacttcttagatgcatttaaattcttaatgcaaatgacgtagcaatttgaaaacttctccgtattacttgtgtttaaaatgtcttgctttaaatacaaaacaaatggtaaaggggattatcttttgtttagatggttaaatattatttttgccttagatagctttgtaataatttttctccagacagttcaacacttttgaaaaatgacatgaattttcattaaaaacccttttcctatgtttattgtatacaagaattatgcaataaaatttctttataaaaata

SEQ ID NO: 153229 - DNA, 4289 bp, Homo sapiens
  Payload ID: 10148
  Gene Symbol: MSRB3
  Gene Name: methionine sulfoxide reductase B3
  Uniprot ID: Q8IXL7
  ENST ID: ENST00000355192
  CDS Start-End: 127-705
atatttggactcggctgcccgtgcccaggaatttcccgtcatgcctcccgccgccccgtccgtcgcccggagccggggagggagggagcgaggttcggacaccggcggcggctgcctggcctttccatgagcccgcggcggaccctcccgcgccccctctcgctctgcctctccctctgcctctgcctctgcctggccgcggctctgggaagtgcgcagtccgggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagtgtggtgctcaccttgggcacatttttgatgatgggcctcgtccaactgggaaaagatactgcataaattcggctgccttgtcttttacacctgcggatagcagtggcaccgccgagggaggcagtggggtcgccagcccggcccaggcagacaaagcggagctctagagtaatggagagtgatggaaacaaagtgtacttaatgcacagcttattaaaaaaatcaaaattgttatcttaatagatatattttttcaaaaactataagggcagttttgtgctattgatattttttcttcttttgcttaaacagaagccctggccatccatgtattttgcaattgactagatcaagaactgtttatagctttagcaaatggagacagctttgtgaaacttcttcacaagccacttataccctttggcattcttttctttgagcacatggcttcttttgcagtttttccccctttgattcagaagcagagggttcatggtcttcaaacatgaaaatagagatctcctctgcagtgtagagaccagagctgggcagtgcagggcatggagacctgcaagacacatggccttgaggcctttgcacagacccacctaagataaggttggagtgatgttttaatgagactgttcagctttgtggaaagtttgagctaaggtcatttttttttttctcactgaaagggtgtgaaggtctaaagtctttccttatgttaaattgttgccagatccaaaggggcatactgagtgttgtggcagagaagtaaacattaccacactgttaggcctttattttattttattttccatcgaaagcattggaggcccagtgcaatggctcacgcctgtgatcccagcactttgggaggccaaggcgggtggatcacgaggtcaggagatggagaccatcctggctaacatggtgaaaccccgtctctactaaaaatacgaaaaattagccaggcgtggtggtgggcacctgtagtcccagctactcaggaggctgaggcaggagaatggcgtgaacccggaaggcggagcttgcagttagccgagatcatgccactgcactccagcctacatgacaatgtgacactccatctcaaaaaataataataataacaatataagaactagctgggcatggtggcgcatgcatgtagtcccagctactcctgaggctcagtcaggagaatcgcttgaacttgggaggcggaggttgcagtgagctgagctcataccactgcactccagcctgaacagagtgagatcctgtcaaaaaagaaaagaaaaagaaagcagcattcaaatgtaagacaactgtaaaatattgagccccacttggtctaaaattcaaaaagaagaacgcctgtccatcgcctttttataagtccttctctccacacctaaaagcagctgcagctggaagggcacaaattccactgtgtaaaataaaatattaggggcaacacacttcatcaaggcagcaggaatgagagagagcagagaagatcaaggatgaagtcttgggtactgaaaaattcagtgctgggcagaaaaactgacagggcagtacaagtaacaaacagaatccaagtggggtggcccttgtgcacagagctccaggtgacctctggagagacatgggcattcacatggaaagctaaaacggaagctcaagtttcatactcaacataatcttctgtgtgacaaaggacaagccatgtagcctctctgtgcctatttcttcatgcataaactgggactcataatatttgtaaaatgtattgatactctcagggcaaattcactatattgctatacagttgagatcagtgttgtaaaattaaactgatctggttctaattgcctcaaaggccaaagcccaggcatttgaaatggaaagaagcagagaggaggctgacttagctgattggtatggaaacagttgggccaagagccagaatttccctttgtagcaacacggctagttttactttgagaagctctgctcagctgctttataacattaagtctggcggaatggatgtcactgtgcacaataaagttttcacaagtataaacaatggtgatgtaagtcaacattgctgtagccaggtgtgaaggttgtatggtgtgtgacgaatgtacatcatgtttgtaggtttggatgctaatcttgaattgtagtttaaaaaatacgtatttttgtaactctttgaaagtttatgaagactgacagctttccttgtaagcactaagagaaaaaaaagaaagagggacatttgacaattttaaagaaacaacaagaaattagaatgaaaatctgtgacaaacagcgtcagtgtggccatgtccacattcctacatgtctctctctacaagcacctctctaagaagcctgacatcccggtggactctttatagtcatgtacacttgattccagatgagctctggtcttatctggatgctcagataagaggtttctatctgagcatccagatgttccctcaggttccaagacatttcaccccaggccctgggttcactctggaattcgtaggcttcacgtctctctagaaatgacgtgtaaaatttaagaccagacctcagccatcagcgtccagaccatcctagaagtctttcccaatctcacagagaaagccctagtatttcccagtgaccccaggattccacgttggggtggccaaagaaataggtctctcagggctttgccacagcctccagcccatccttcagaggcacacacagcacctctcggctgctccagctctgtaggatagcctcccctggggtccgtgggacgcgggccacagtgttgaggtagacaaggaggatcagtgagaggcctcttccctctccacagagactggattgtcattgttccttcatttatatcgtagggcttaacatttcactcaaaaaaaagcccctctttttctaatccttagtctttgtttcaaggaaagccagtttttcttctaccacattttccaggatcgactttaagaaaaatgcaacatctattgaaaaaaagtggggtgtatgcatgtggtttaattccagattgcttttgggtttaagtggtatcaaatttcagtatatttctgtcttatgtgaaagaaatatattactaaaacgtcagtgagcaataatgtcagctgtcaagcactagatttatttttgcaggatatggagtgcaatgaactgagtcaatatggcaaggtgtatgtgatctgtgggagttatgccatttaacataggaagtgcatgggactttccctctctgcactccagctcttactgtaccattagaagatgcagaattctgttggtgtgcaaaaagtatagccttacattcaagcagaatggatctgaagaaagcagcaatatctgttactagagaacattcccatgtgtttaaactcttcacttcttagatgcatttaaattcttaatgcaaatgacgtagcaatttgaaaacttctccgtattacttgtgtttaaaatgtcttgctttaaatacaaaacaaatggtaaaggggattatcttttgtttagatggttaaatattatttttgccttagatagctttgtaataatttttctccagacagttcaacacttttgaaaaatgacatgaattttcattaaaaacccttttcctatgtttattgtatacaagaattatgcaataaaatttctttataaaaat

SEQ ID NO: 153230 - DNA, 506 bp, Homo sapiens
  Payload ID: 10148
  Gene Symbol: MSRB3
  Gene Name: methionine sulfoxide reductase B3
  ENST ID: ENST00000446731
  CDS Start-End: 1-352
actgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagcaagaaggacctcaccagatgctgcccctcaatcttggatttcctggcctccagaactgtgagccaataaatttctattcattctgaattaaccagtctgtggtattctcttatagcagcacaaaatgaactgagacaggtgtgctcactcagtgaaaatgttttgaactgcatgcttatgcttatgaattgttaacttctctgcgtgcatgttacatttcaataaaaaaagtttactcag

SEQ ID NO: 153231 - DNA, 884 bp, Homo sapiens
  Payload ID: 10148
  Gene Symbol: MSRB3
  Gene Name: methionine sulfoxide reductase B3
  ENST ID: ENST00000540804
  CDS Start-End: 38-520
gaggttcggacaccggcggcggctgcctggcctttccatgagcccgcggcggaccctcccgcgccccctctcgctctgcctctccctctgcctctgcctctgcctggccgcggctctgggaagtgcgcagtccgggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcaggtgagttcatcctttctgaaaacccaatacattgctttcaggactcctggttgtgctaaatatagcaactaaggccaagcgactggtcacaagaaggacagacaagcatgacgaagtttatatgaagtccgatggatgcctatgttcaggtgtttagcaagtctagtggaatgttaaggtcggcatgatagctcaagcctgtaatcccatactttgagagggccaagtggggaggatcacttgaggccagaagttcaagacgagtccgggcaacctagtgagacctcgtctctacagaaaatattttaaaacttagcagggcatggtagcatatgcctgtagttctagctactcaggggggctgaagcaggagaatcactggagcccaggaggtcgaggctgcagtgagctgtgatcatgccactgtagtctagcc

SEQ ID NO: 153232 - DNA, 528 bp, Homo sapiens
  Payload ID: 10148
  Gene Symbol: MSRB3
  Gene Name: methionine sulfoxide reductase B3
  ENST ID: ENST00000541189
  CDS Start-End: 1-523
ccggcggcggctgcctggcctttccatgagcccgcggcggaccctcccgcgccccctctcgctctgcctctccctctgcctctgcctctgcctggccgcggctctgggaagtgcgcagtccgggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagcaagaaggacctcaccagatgctgcccctcaatcttggatttcctggcctccagaactgtgagccaataaatttctattcattctgaattaa

SEQ ID NO: 153233 - DNA, 964 bp, Homo sapiens
  Payload ID: 10148
  Gene Symbol: MSRB3
  Gene Name: methionine sulfoxide reductase B3
  Uniprot ID: Q8IXL7
  ENST ID: ENST00000535664
  CDS Start-End: 340-897
caccggcggcggctgcctggcctttccatgagcccgcggcggaccctcccgcgccccctctcgctctgcctctccctctgcctctgcctctgcctggccgcggctctgggaagtgcgcagtccgagtgacatcactgcctctcttcctgtgcgctggctttgacataagccagatggccaccgtggttggtaggcgcccaggctgcctggtacaggagttgatgaaacagaataggaagacgttttatggtcagctgtggaagcacagtgagactgcagctttgctaactcttgcccctgttctttgcttctcgttttgttggtgaagatatcacagtgatgtctgcattcaacctgctgcatttggtgacaaagagccagccagtagcccttcgagcctgtgggcttccctcagggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagtgtggtgctcaccttgggcacatttttgatgatgggcctcgtccaactgggaaaagatactgcataaattcggctgccttgtcttttacacctgcggatagcagtggcaccgccgagggaggcagtggggtcgccagcccggcccaggcagacaaagcggagctctagagtaatggagagtgatggaaacaaagtgtacttaatgcacagcttattaaaaaaatcaaaattgtta

SEQ ID NO: 153234 - DNA, 527 bp, Homo sapiens
  Payload ID: 10148
  Gene Symbol: MSRB3
  Gene Name: methionine sulfoxide reductase B3
  ENST ID: ENST00000538045
  CDS Start-End: 176-527
acgttagggtgtgaccccgagccgggattccattctgcgcctgctgcgccccctcggccacctgcggggacagcccctgcctcagccgagaaggggagcagaagggttgcgccccgcgccagcgctcttgcccctgttctttgcttctcgttttgttggtgaagatatcacagtgatgtctgcattcaacctgctgcatttggtgacaaagagccagccagtagcccttcgagcctgtgggcttccctcagggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgactttt

SEQ ID NO: 153235 - DNA, 489 bp, Homo sapiens
  Payload ID: 10148
  Gene Symbol: MSRB3
  Gene Name: methionine sulfoxide reductase B3
  ENST ID: ENST00000541897
  CDS Start-End: 101-235
aggaatttcccgtcatgcctcccgccgccccgtccgtcgcccggagccggggagggagggagcgaggttcggacaccggcggcggctgcctggcctttccatgagcccgcggcggaccctcccgcgccccctctcgctctgcctctccctctgcctctgcctctgcctggccgcggctctgggaagtgcgcagtccgctcttgcccctgttctttgcttctcgttttgttggtgaagatatcacagtgatgtctgcattcaacctgctgcatttggtgacaaagagccagccagtagcccttcgagcctgtgggcttccctcaggtcagaaaccaaatttgactccggttcaggttggccttcattccacgatgtgatcaattctgaggcaatcacattcacagatgacttttcctatgggatgcacagggtggaaacaagctgctctcagtgtggtgctcaccttgggcacatttttgatgatgggcc

SEQ ID NO: 153236 - DNA, 630 bp, Homo sapiens
  Payload ID: 10148
  Gene Symbol: MSRB3
  Gene Name: methionine sulfoxide reductase B3
  ENST ID: ENST00000535239
  CDS Start-End: 137-630
ctgcggggacagcccctgcctcagccgagaaggggagcagaagggttgcgccccgcgccagcggtgaggggccgaacggaaggagctcttgcccctgttctttgcttctcgttttgttggtgaagatatcacagtgatgtctgcattcaacctgctgcatttggtgacaaagagccagccagtagcccttcgagcctgtgggcttccctcagggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagtgtggtgctcaccttgggcacatttttgatgatgggcctcgtccaactgggaaaagatactgcataaattcggctgccttgtcttttacacctgcggatagcag

SEQ ID NO: 153237 - DNA, 4270 bp, Homo sapiens
  Payload ID: 10148
  Gene Symbol: MSRB3
  Gene Name: methionine sulfoxide reductase B3
  Uniprot ID: Q8IXL7
  ENST ID: ENST00000614640
  CDS Start-End: 137-694
ctgcggggacagcccctgcctcagccgagaaggggagcagaagggttgcgccccgcgccagcggtgaggggccgaacggaaggagctcttgcccctgttctttgcttctcgttttgttggtgaagatatcacagtgatgtctgcattcaacctgctgcatttggtgacaaagagccagccagtagcccttcgagcctgtgggcttccctcagggtcgtgtagggataaaaagaactgtaaggtggtcttttcccagcaggaactgaggaagcggctaacacccctgcagtaccatgtcactcaggagaaagggaccgaaagtgcctttgaaggagaatacacacatcacaaagatcctggaatatataaatgtgttgtttgtggaactccattgtttaagtcagaaaccaaatttgactccggttcaggttggccttcattccacgatgtgatcaattctgaggcaatcacattcacagatgacttttcctatgggatgcacagggtggaaacaagctgctctcagtgtggtgctcaccttgggcacatttttgatgatgggcctcgtccaactgggaaaagatactgcataaattcggctgccttgtcttttacacctgcggatagcagtggcaccgccgagggaggcagtggggtcgccagcccggcccaggcagacaaagcggagctctagagtaatggagagtgatggaaacaaagtgtacttaatgcacagcttattaaaaaaatcaaaattgttatcttaatagatatattttttcaaaaactataagggcagttttgtgctattgatattttttcttcttttgcttaaacagaagccctggccatccatgtattttgcaattgactagatcaagaactgtttatagctttagcaaatggagacagctttgtgaaacttcttcacaagccacttataccctttggcattcttttctttgagcacatggcttcttttgcagtttttccccctttgattcagaagcagagggttcatggtcttcaaacatgaaaatagagatctcctctgcagtgtagagaccagagctgggcagtgcagggcatggagacctgcaagacacatggccttgaggcctttgcacagacccacctaagataaggttggagtgatgttttaatgagactgttcagctttgtggaaagtttgagctaaggtcatttttttttttctcactgaaagggtgtgaaggtctaaagtctttccttatgttaaattgttgccagatccaaaggggcatactgagtgttgtggcagagaagtaaacattaccacactgttaggcctttattttattttattttccatcgaaagcattggaggcccagtgcaatggctcacgcctgtgatcccagcactttgggaggccaaggcgggtggatcacgaggtcaggagatggagaccatcctggctaacatggtgaaaccccgtctctactaaaaatacgaaaaattagccaggcgtggtggtgggcacctgtagtcccagctactcaggaggctgaggcaggagaatggcgtgaacccggaaggcggagcttgcagttagccgagatcatgccactgcactccagcctacatgacaatgtgacactccatctcaaaaaataataataataacaatataagaactagctgggcatggtggcgcatgcatgtagtcccagctactcctgaggctcagtcaggagaatcgcttgaacttgggaggcggaggttgcagtgagctgagctcataccactgcactccagcctgaacagagtgagatcctgtcaaaaaagaaaagaaaaagaaagcagcattcaaatgtaagacaactgtaaaatattgagccccacttggtctaaaattcaaaaagaagaacgcctgtccatcgcctttttataagtccttctctccacacctaaaagcagctgcagctggaagggcacaaattccactgtgtaaaataaaatattaggggcaacacacttcatcaaggcagcaggaatgagagagagcagagaagatcaaggatgaagtcttgggtactgaaaaattcagtgctgggcagaaaaactgacagggcagtacaagtaacaaacagaatccaagtggggtggcccttgtgcacagagctccaggtgacctctggagagacatgggcattcacatggaaagctaaaacggaagctcaagtttcatactcaacataatcttctgtgtgacaaaggacaagccatgtagcctctctgtgcctatttcttcatgcataaactgggactcataatatttgtaaaatgtattgatactctcagggcaaattcactatattgctatacagttgagatcagtgttgtaaaattaaactgatctggttctaattgcctcaaaggccaaagcccaggcatttgaaatggaaagaagcagagaggaggctgacttagctgattggtatggaaacagttgggccaagagccagaatttccctttgtagcaacacggctagttttactttgagaagctctgctcagctgctttataacattaagtctggcggaatggatgtcactgtgcacaataaagttttcacaagtataaacaatggtgatgtaagtcaacattgctgtagccaggtgtgaaggttgtatggtgtgtgacgaatgtacatcatgtttgtaggtttggatgctaatcttgaattgtagtttaaaaaatacgtatttttgtaactctttgaaagtttatgaagactgacagctttccttgtaagcactaagagaaaaaaaagaaagagggacatttgacaattttaaagaaacaacaagaaattagaatgaaaatctgtgacaaacagcgtcagtgtggccatgtccacattcctacatgtctctctctacaagcacctctctaagaagcctgacatcccggtggactctttatagtcatgtacacttgattccagatgagctctggtcttatctggatgctcagataagaggtttctatctgagcatccagatgttccctcaggttccaagacatttcaccccaggccctgggttcactctggaattcgtaggcttcacgtctctctagaaatgacgtgtaaaatttaagaccagacctcagccatcagcgtccagaccatcctagaagtctttcccaatctcacagagaaagccctagtatttcccagtgaccccaggattccacgttggggtggccaaagaaataggtctctcagggctttgccacagcctccagcccatccttcagaggcacacacagcacctctcggctgctccagctctgtaggatagcctcccctggggtccgtgggacgcgggccacagtgttgaggtagacaaggaggatcagtgagaggcctcttccctctccacagagactggattgtcattgttccttcatttatatcgtagggcttaacatttcactcaaaaaaaagcccctctttttctaatccttagtctttgtttcaaggaaagccagtttttcttctaccacattttccaggatcgactttaagaaaaatgcaacatctattgaaaaaaagtggggtgtatgcatgtggtttaattccagattgcttttgggtttaagtggtatcaaatttcagtatatttctgtcttatgtgaaagaaatatattactaaaacgtcagtgagcaataatgtcagctgtcaagcactagatttatttttgcaggatatggagtgcaatgaactgagtcaatatggcaaggtgtatgtgatctgtgggagttatgccatttaacataggaagtgcatgggactttccctctctgcactccagctcttactgtaccattagaagatgcagaattctgttggtgtgcaaaaagtatagccttacattcaagcagaatggatctgaagaaagcagcaatatctgttactagagaacattcccatgtgtttaaactcttcacttcttagatgcatttaaattcttaatgcaaatgacgtagcaatttgaaaacttctccgtattacttgtgtttaaaatgtcttgctttaaatacaaaacaaatggtaaaggggattatcttttgtttagatggttaaatattatttttgccttagatagctttgtaataatttttctccagacagttcaacacttttgaaaaatgacatgaattttcattaaaaacccttttcctatgtttattgtatacaagaattatgcaataaaatttcttt

SEQ ID NO: 153238 - DNA, 2791 bp, Homo sapiens
  Payload ID: 10149
  Gene Symbol: METAP1
  Gene Name: methionyl aminopeptidase 1
  Uniprot ID: P53582
  ENST ID: ENST00000296411
  CDS Start-End: 135-1295
ctcccgcgcccaggccagcggcgggcccagctcctcccccgactcggtctctctcccctcccctccgcccggcagttcctccctcccgccgccgcctcttcctcggtgaggcgctcttccagcgggcaggcagcatggcggccgtggagacgcgggtgtgcgagacagacggctgcagcagtgaggccaagctccagtgtcccacttgcatcaagctgggcatccagggctcgtacttctgctcgcaggaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatcctaccat

SEQ ID NO: 153239 - DNA, 1058 bp, Homo sapiens
  Payload ID: 10149
  Gene Symbol: METAP1
  Gene Name: methionyl aminopeptidase 1
  ENST ID: ENST00000514051
  CDS Start-End: 1-351
ctttatcgcaatggttatcatggggacctgaatgagacattttttgttggagaagtggatgatggagcacggaaacttgttcagaccacatatgagtgcctgatgcaagccattgatgcagaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtt

SEQ ID NO: 153240 - DNA, 715 bp, Homo sapiens
  Payload ID: 10149
  Gene Symbol: METAP1
  Gene Name: methionyl aminopeptidase 1
  ENST ID: ENST00000510133
  CDS Start-End: 1-513
gcatgtattgcaagaaattgctacccttctcccctgaattattataatttcccaaagtcttgttgtacctcagtgaatgaagtcatttgccatggaataccagacagaaggcccttacaagaaggtgacattgttaatgtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaa

SEQ ID NO: 153241 - DNA, 653 bp, Homo sapiens
  Payload ID: 10149
  Gene Symbol: METAP1
  Gene Name: methionyl aminopeptidase 1
  ENST ID: ENST00000503247
  CDS Start-End: 1-135
gagacgcgggtgtgcgagacagacggctgcagcagtgaggccaagctccagtgtcccacttgcatcaagctgggcatccagggctcgtacttctgctcgcagcaacgtggaaggaaccagaggctgttattctaagtgaagtaactctggaatggaaaaccaagtaccaggtcgtctcgcttacaagtaggagctaagctgtgggaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttagataatgatactgagacacccagcgaagataggtaatttgcaacacaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacactta

SEQ ID NO: 153242 - DNA, 553 bp, Homo sapiens
  Payload ID: 10149
  Gene Symbol: METAP1
  Gene Name: methionyl aminopeptidase 1
  ENST ID: ENST00000506238
  CDS Start-End: 15-161
agcgggcaggcagcatggcggccgtggagacgcgggtgtgcgagacagacggctgcagcagtgaggccaagctccagtgtcccacttgcatcaagctgggcatccagggctcgtacttctgctcgcagcaacgtggaaggaaccagaggctgttattctaagtgaagtaactctggaatggaaaaccaagtaccaggtcgtctcgcttacaagtaggagctaagctgaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttagataatgatactgagacacccagcgaagataggtaatttgcaacacaggctcttaaaggtacttctcagattaaattactctcatctgaagatatagaaggg

SEQ ID NO: 153243 - DNA, 770 bp, Homo sapiens
  Payload ID: 10149
  Gene Symbol: METAP1
  Gene Name: methionyl aminopeptidase 1
  ENST ID: ENST00000510107
  CDS Start-End: 1-116
tcaagctgggcatccagggctcgtacttctgctcgcaggaatgttttaaaggaagttgggctactcacaagttactacataagaaagcaaagagaaggtgttatgtaatgtcttaaactggctccaccaaactttgtgaccatgggttattctaagtctcacctccaagatgctggaatcataggtttgtgtgaggattaaataaagaaatccatgagaagtgcttagcatgtgtaccatgcataaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttagaattttcctggctattcttgcatgtttgtttttccatgtgaaatttagaatcagcttgtctggttctcaaaattatcctgttgacatttttttattgggatagtattaaatttatagattaattttggaagaattgacatctttacaatattgagtcttcctgtccaggaacagggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacactta

SEQ ID NO: 153244 - DNA, 718 bp, Homo sapiens
  Payload ID: 10149
  Gene Symbol: METAP1
  Gene Name: methionyl aminopeptidase 1
  ENST ID: ENST00000507537
  CDS Start-End: 34-180
ctcggtgaggcgctcttccagcgggcaggcagcatggcggccgtggagacgcgggtgtgcgagacagacggctgcagcagtgaggccaagctccagtgtcccacttgcatcaagctgggcatccagggctcgtacttctgctcgcagcaacgtggaaggaaccagaggctgttattctaagtgaagtaactctggaatggaaaaccaagtaccaggtcgtctcgcttacaagtaggagctaagctgaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctc

SEQ ID NO: 153245 - DNA, 147 bp, Homo sapiens
  Payload ID: 10149
  Gene Symbol: METAP1
  Gene Name: methionyl aminopeptidase 1
  ENST ID: ENST00000625963
  CDS Start-End: 1-147
atggcggccgtggagacgcgggtgtgcgagacagacggctgcagcagtgaggccaagctccagtgtcccacttgcatcaagctgggcatccagggctcgtacttctgctcgcagcaacgtggaaggaaccagaggctgttattctaa

SEQ ID NO: 153246 - DNA, 1836 bp, Homo sapiens
  Payload ID: 10150
  Gene Symbol: METAP2
  Gene Name: methionyl aminopeptidase 2
  Uniprot ID: P50579
  ENST ID: ENST00000261220
  CDS Start-End: 31-1398
gtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcaggggaacaggaacctgataaagaatcaggagcctcagtggatgaagtagcaagacagttggaaagatcagcattggaagataaagaaagagatgaagatgatgaagcaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcagatctg

SEQ ID NO: 153247 - DNA, 3601 bp, Homo sapiens
  Payload ID: 10150
  Gene Symbol: METAP2
  Gene Name: methionyl aminopeptidase 2
  Uniprot ID: P50579
  ENST ID: ENST00000323666
  CDS Start-End: 230-1666
gcagtcgggtctggccccagtcgactccagccaggcggggctccaagccgagactcctgcacgcccggcccgaagctagcccgacaccctcagctgagtcctccgccgtcccagcattccctgcgtccctaccatcgagagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcagatctgagagctacatctcaatgtctgtggttataattctggacaggataaatagctaaacttaatgtaggcaaatgcagagacatttatctgaaatgtagacctctacactgagacttttctggcatagtggctaaaacaagatctacacatgcataaaaagggacaatcaccttttcttcataaatatacagctttaggaatatttcaccattctttgtaggacatagtagtccttgtctttttttctcctgacattggaaagatgtgctaattgaaacttgacttagtaggaacattgtgccaactcaaaaccttgatttagtaaaaatctcaatgtttagatcctttgtccagtggtggtgtttatcagggaatgtattcagcttgctcagaaaaccaaaagggtattaaagccacaaaagcaaagaagaaaaaaaaaaacttcccatgtttggatcttgttctagttagaaaaattaagttgaaattcttggactttttcattcatgaggcaaatgctgtaataccttcccctttgacaggtttggattcttaacattactagtggtatttcaggaagtgacgttacagttactttccttatagcggctaagtgtattaagttgaatgtaacgatggtaatattaatttgtttgaactgaggcccactactgattctttgacaaattgaattcttatatttaaataattttatgggaatgttccatcataatttctaaatcatttatatatcaaggtagccttaatttgtatatgtttcagtacaatgagattttattgcctctgggatgctgtttagtttgtattttgttgaacgtttttatcctaggaagagaaacctatgacttgtgtacctagatcatctgttacattaaaaagctgctctttcagcattagagctataaatgaatgttaccttgtcgggaaacaatctaggttttagctgtatgagctatgtttattatggtgctaatgttcagtagccacatttgactaatgtctccattctctgtgatgctgtggctagcagcagagctcgccagttcatgcctggacatactgtcagggctgggccctccagctagctcctttggggttgagtccgtatctttttgatgtggaagtataaagcaagtatcttgatttctaaacccagcaattttagaattgacctttatgagtgaagacttttggagcttttaaagaccttggcagtcatgatctcaaaccaattaggagctccaagctcccttcccaggtaactgttgggagcaatggcatcactgtatgcccttgtaatggctggaagggacatgatcttgtaagtaggaaagctgtaactaaaaattgtattgtttgcttattagccatgtatctcttaaaattttgttatgtttacaacgatgtaccttattggcaacaagttattagtttgatgtttaacaatagtgcctttagtaaattattttacaactaaaa

SEQ ID NO: 153248 - DNA, 2431 bp, Homo sapiens
  Payload ID: 10150
  Gene Symbol: METAP2
  Gene Name: methionyl aminopeptidase 2
  ENST ID: ENST00000535095
  CDS Start-End: 661-1647
gtcctgaattggaaagtgagcggagtgtgacgggttcccatcttgaaccgtccggggttgagtagtacaataaactaacacggaactccagcttccaaaattctctccagtgcctacagagcctcgcggagagctgtgattgtgaatgtcaacgcagatttgattaaatctcttagatttaagagatatgtggagtcatgacaatagaaatgtgtacaagtgaacacatttcttagcccgtttccccactgcctgtgtgatttataaaaacgcaaatataaaatatttccgttccagcagagacgccgcttgctacggcgggttgcccgtctccacaggtatctccggctgactctagagctcaacttcccctttaaacttcaccctgcgcttgccgatttgcttcgggaatgcccgaggcaccggacgaagcagtcgggtctggccccagtcgactccagccaggcggggctccaagccgagactcctgcacgcccggcccgaagctagcccgacaccctcagctgagtcctccgccgtcccagcattccctgcgtccctaccatcgagagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcagatctg

SEQ ID NO: 153249 - DNA, 538 bp, Homo sapiens
  Payload ID: 10150
  Gene Symbol: METAP2
  Gene Name: methionyl aminopeptidase 2
  ENST ID: ENST00000549808
  CDS Start-End: 50-538
gtgcaaataatttttttttaatgttggctactaaagggcttagagccaaatgtgtggtttttgtgttggcctcatttcagcaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaaattcttg

SEQ ID NO: 153250 - DNA, 1862 bp, Homo sapiens
  Payload ID: 10150
  Gene Symbol: METAP2
  Gene Name: methionyl aminopeptidase 2
  Uniprot ID: P50579
  ENST ID: ENST00000546753
  CDS Start-End: 100-1467
accatcgagagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggacgacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaacctt

SEQ ID NO: 153251 - DNA, 513 bp, Homo sapiens
  Payload ID: 10150
  Gene Symbol: METAP2
  Gene Name: methionyl aminopeptidase 2
  ENST ID: ENST00000549502
  CDS Start-End: 29-513
ctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaaggatacaagatctccctcccgtcacccaggctgacgtgctgtggctcgatctcagctcactgcagccttgacttccctggctcagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaaga

SEQ ID NO: 153252 - DNA, 1779 bp, Homo sapiens
  Payload ID: 10150
  Gene Symbol: METAP2
  Gene Name: methionyl aminopeptidase 2
  ENST ID: ENST00000550777
  CDS Start-End: 26-1354
attccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagac

SEQ ID NO: 153253 - DNA, 564 bp, Homo sapiens
  Payload ID: 10150
  Gene Symbol: METAP2
  Gene Name: methionyl aminopeptidase 2
  ENST ID: ENST00000553151
  CDS Start-End: 29-564
ctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactg

SEQ ID NO: 153254 - DNA, 1874 bp, Homo sapiens
  Payload ID: 10150
  Gene Symbol: METAP2
  Gene Name: methionyl aminopeptidase 2
  ENST ID: ENST00000551840
  CDS Start-End: 19-1452
cgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaa

SEQ ID NO: 153255 - DNA, 3419 bp, Homo sapiens
  Payload ID: 10151
  Gene Symbol: METAP1D
  Gene Name: methionyl aminopeptidase type 1D (mitochondrial)
  Uniprot ID: Q6UB28
  ENST ID: ENST00000315796
  CDS Start-End: 388-1395
atgttgaacactagattgtgctttattttttccgcccaacttcacgtttccatgcaccaaaatgttgatgctataaatattggatgccacgcttacctgacaggcttcttccatcccacctgggcgcgggggctcagagcgagcgcgcgagccgcggctggagcccgcctctcgcggctggagaggactcagccggccgcgggttctgctgcttgcccgggtgccctagccgcttcccagccagggctcccgcagtcagccccgcgcgcgcacgcgcgctcccctcgggcggcctcgacgcctcagggcttcggcagggctgcgactggccggctccagcgggcggggcggcgagcgagtgctcgcggccacgtgaccgacgccaacatggcggcgcccagtggcgtccacctgctcgtccgcagaggttctcatagaattttctcttcaccactcaatcatatctacttacacaagcagtcaagcagtcaacaaagaagaaatttcttttttcggagacaaagagatatttcacacagtatagttttgccggctgcagtttcttcagctcatccggttcctaagcacataaagaagccagactatgtgacgacaggcattgtaccagactggggagacagcatagaagttaagaatgaagatcagattcaagggcttcatcaggcttgtcagctggcccgccacgtcctcctcttggctgggaagagtttaaaggttgacatgacaactgaagagatagatgctcttgttcatcgggaaatcatcagtcataatgcctatccctcacctctaggctatggaggttttccaaaatctgtttgtacctctgtaaacaacgtgctctgtcatggtattcctgacagtcgacctcttcaggatggagatattatcaacattgatgtcacagtctattacaatggctaccatggagacacctctgaaacatttttggtgggcaatgtggacgaatgtggtaaaaagttagtggaggttgccaggaggtgtagagatgaagcaattgcagcttgcagagcaggggctcccttctctgtaattggaaacacaatcagccacataactcatcagaatggttttcaagtctgtccacattttgtgggacatggaataggatcttactttcatggacatccagaaatttggcatcatgcaaacgacagtgatctacccatggaggagggcatggcattcactatagagccaatcatcacggagggatcccctgaatttaaagtcctggaggatgcatggactgtggtctccctagacaatcaaaggtcggcgcagttcgagcacacggttctgatcacgtcgaggggcgcgcagatcctgaccaaactaccccatgaggcctgaggagccgcccgaaggtcgcggtgacctggtgcctttttaaataaattgctgaaatttggctggagaacttttagaagaaacagggaaatgaccggtggtgcggtaacctgcgtggctcctgatagcgtttggaagaacgcgggggagactgaagagcaactgggaactcggatctgaagccctgctggggtcgcgcggctttggaaaaacaaatcctggccctggactcggtttcccagcgcggtcaacgcatctggaggggactggaggaaacccccttgttggaagagattccaagagaagcacggttttctctttcccttgccctgactgttggagtaaaaaacctcttaaatccattgtatcagaggtccttacctctctgacagttacagtgatctttgtatctgaactttgcacgtctgccgaaaaatccgaacctgttgactgggatttttaagaatccgtttctcccttttgtgtattccatattggccggccccaaggatgctcgcagaagccagcccccaaccccagcccttccgtatctttcccctccatcgcggctttgcgatgaaagattagcccgcgaacagaggcattgattacaaacatgtccttggcagtggactctgggcctggccattcttcaggtttctgtcaatccagaaacgcgactttcctggacccctgcggctcttcctcccccgcccacatccagccctccaaggccagtccagaggtgaagtttgaggccctccccccacccaccccacacgcacgcacgcacgctagaccgtttgctgcactaggaattcgagcttgggccccactcgcccaggtgtgaacagtggctgattagtgggcggtctagtctctaaaatgacccctccccagactggcccttctcgcatcgggacccgcgcttgcacgctgcaggagccgcaaacgtcagctgttctggaaaccgagagggtcccagagagaggagatacgggcgcatttgagagcaagggcctacttggccgggactgaagcttgcgagttgagctccagttcggccggcagttccatcccgcttcaggaacaggaatccaagggcccacgctctgtctgccaagggccattcctgcccggagcaccctcctttcccttgcgcttgctctccggtacctgttcctcacctgagctcaagggcagggagaggccgggcctctggcagtccacgaaggaagccgtctgccttcggttatgattttaggaacaagtccaacgagggtgttcaagcagttaatggttgtgctaactcttgtttctactgaagcgggttttgcaaagctgacatcccttaaagataacttgggctttcggaagcggcaaggaaatggcacctgtagttgccaggacaggtggtgtcctcggccaggactaagagccagctcatctttgtaacattcataatacgggaaactgaggaccaggtggctcggaaaagagatgagttccagcttttacctaacacagggttctctcgtcgtcccccaacccctccagctcggcttctttgtgtccagggttgtagatttttggatagaggtgtttctgattctagtgagtctgagaactggaaaagaccaaggaggggttgatgatttacaaggtccatagaaaaactttttgtgtggtcggaagttggccaagcagaggcccacagcctgatgctactgccccccacccccccaaagatctgaattccctaaagatcaagagggttcagctggccttgggagatgtttgctggagaatgacttcagttttctcctaaggcaatcagattgcaaccattagcattgtatcttatctgcaaatcagtttactccgaggttccccaaggatagttttattaggaccacaggactttactaaccactgaggtaacacgctgcttgtgcagcaattattttgaggtggaggtatttatgggacaagtttataattccatttattaaagggactaacctaaa

SEQ ID NO: 153256 - DNA, 2905 bp, Homo sapiens
  Payload ID: 10152
  Gene Symbol: MARS
  Gene Name: methionyl-tRNA synthetase
  Uniprot ID: P56192
  ENST ID: ENST00000262027
  CDS Start-End: 135-2837
agtctactttccggtagcggtgccagggcagtggcctaatacggaactccatttcccggcgtgcctcgcggaggccgctgaactcagaagcgggaggccggttccggttgcatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctat

SEQ ID NO: 153257 - DNA, 2979 bp, Homo sapiens
  Payload ID: 10152
  Gene Symbol: MARS
  Gene Name: methionyl-tRNA synthetase
  ENST ID: ENST00000545888
  CDS Start-End: 26-448
gcatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctgggaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggtgagaaagctaaaggctgtgccctcgctccacaacagccacagcatcacttccctaatttccctaagtagtcctcacccatcactctttccatcttttggccctgccgcttcctcacttacagtttttctttcctgtcttaactagaagagaccttcgacttaaaggtaaccactttccctctgagatgctgtataaaactggaggttaggggatatttatggttgctggtgataactttgttgttctccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaa

SEQ ID NO: 153258 - DNA, 3592 bp, Homo sapiens
  Payload ID: 10152
  Gene Symbol: MARS
  Gene Name: methionyl-tRNA synthetase
  Uniprot ID: P56192
  ENST ID: ENST00000537638
  CDS Start-End: 687-2327
tgttgttgataggatggatatgtacactaacttccactttgtcactaattccgcacatggtaactccgaactctaaaactctgaccgttaagagcttgcatcgagagccactgcgagtagctgctgttatgacatggccatttcattctccacaacaagagaagcagccgcggcttcagtcaccgccctccagcagcgtaagaggataaaagtgcgacttgccctaaaacctaaacgtctcttctggatctccagaaaaaaagtgctgctctaggccgggcgcagtggctcacgcctgtaatcctagcactttggcaggccgaggcgggcggatcatctgaggtgaggacttcgagaccagcctagccaaaatggtcaaagcccgcctctactaaaaatacaaaaattagccgagcgtggtggcacgtgcctgtagtcccagctgcatgggaggctgaggccggagaatcacttgaaccctggaggcagaggttgcagcgagccaagaccgtgccactgcacttcagcccagcgttgcatgatgggagaaatagtctactttccggtagcggtgccagggcagtggcctaatacggaactccatttcccggcgtgcctcgcggaggccgctgaactcagaagcgggaggccggttccggttgcatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaaccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggaggtgaaacataggtacccccattttcatctgaagacaggacctcttgcaggtcctcataccaggcttccagctcccagctggacagtgtcccgaaggagaaaggcaatgactcagctgccatctctgcagttggatcagtctggaaaagcacatctgcaggataatggggagtggctggaacaagctccatgtagcaaacagtctatgccacaagttggcaagctggtctgatgcctgtttttgtaggtaaagttgtactggaatacagccacatctgtttattt

SEQ ID NO: 153259 - DNA, 559 bp, Homo sapiens
  Payload ID: 10152
  Gene Symbol: MARS
  Gene Name: methionyl-tRNA synthetase
  ENST ID: ENST00000551431
  CDS Start-End: 24-311
atcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccg

SEQ ID NO: 153260 - DNA, 510 bp, Homo sapiens
  Payload ID: 10152
  Gene Symbol: MARS
  Gene Name: methionyl-tRNA synthetase
  ENST ID: ENST00000547501
  CDS Start-End: 24-356
atcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggtt

SEQ ID NO: 153261 - DNA, 532 bp, Homo sapiens
  Payload ID: 10152
  Gene Symbol: MARS
  Gene Name: methionyl-tRNA synthetase
  ENST ID: ENST00000549074
  CDS Start-End: 24-368
atcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgc

SEQ ID NO: 153262 - DNA, 555 bp, Homo sapiens
  Payload ID: 10152
  Gene Symbol: MARS
  Gene Name: methionyl-tRNA synthetase
  ENST ID: ENST00000552499
  CDS Start-End: 1-246
gtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccagaagagaccttcgacttaaaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctcta

SEQ ID NO: 153263 - DNA, 699 bp, Homo sapiens
  Payload ID: 10152
  Gene Symbol: MARS
  Gene Name: methionyl-tRNA synthetase
  ENST ID: ENST00000552371
  CDS Start-End: 1-699
gtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcg

SEQ ID NO: 153264 - DNA, 699 bp, Homo sapiens
  Payload ID: 10152
  Gene Symbol: MARS
  Gene Name: methionyl-tRNA synthetase
  ENST ID: ENST00000551172
  CDS Start-End: 1-373
gaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggtgagaaagctaaaggctgtgccctcgctccacaacagccacagcatcacttccctaatttccctaagtagtcctcacccatcactctttccatcttttggccctgccgcttcctcacttacagtttttctttcctgtcttaactagaagagaccttcgacttaaaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctct

SEQ ID NO: 153265 - DNA, 434 bp, Homo sapiens
  Payload ID: 10152
  Gene Symbol: MARS
  Gene Name: methionyl-tRNA synthetase
  ENST ID: ENST00000552007
  CDS Start-End: 7-222
ggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagg

SEQ ID NO: 153266 - DNA, 670 bp, Homo sapiens
  Payload ID: 10152
  Gene Symbol: MARS
  Gene Name: methionyl-tRNA synthetase
  ENST ID: ENST00000547665
  CDS Start-End: 1-358
gcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaagtatgaagcttaagccctgtgggagactggacaagctgaatcctaaatagatctttttcttgcctcactgttacctccccacccccctttatcttagggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaa

SEQ ID NO: 153267 - DNA, 294 bp, Homo sapiens
  Payload ID: 10152
  Gene Symbol: MARS
  Gene Name: methionyl-tRNA synthetase
  ENST ID: ENST00000548944
  CDS Start-End: 1-177
ggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaa

SEQ ID NO: 153268 - DNA, 734 bp, Homo sapiens
  Payload ID: 10152
  Gene Symbol: MARS
  Gene Name: methionyl-tRNA synthetase
  ENST ID: ENST00000552914
  CDS Start-End: 1-660
gagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaa

SEQ ID NO: 153269 - DNA, 748 bp, Homo sapiens
  Payload ID: 10152
  Gene Symbol: MARS
  Gene Name: methionyl-tRNA synthetase
  ENST ID: ENST00000551892
  CDS Start-End: 7-189
ggcgaaatgagactgttcgtgagtgatggcgtcccgggttgcttgccggtgctggccgccgccgggagagcccggggcagagcagaggtgctcatcagcactgtaggcccggaagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgac

SEQ ID NO: 153270 - DNA, 216 bp, Homo sapiens
  Payload ID: 10152
  Gene Symbol: MARS
  Gene Name: methionyl-tRNA synthetase
  ENST ID: ENST00000630571
  CDS Start-End: 1-216
atgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccggagacagaatctctag

SEQ ID NO: 153271 - DNA, 183 bp, Homo sapiens
  Payload ID: 10152
  Gene Symbol: MARS
  Gene Name: methionyl-tRNA synthetase
  ENST ID: ENST00000630803
  CDS Start-End: 1-183
atgagactgttcgtgagtgatggcgtcccgggttgcttgccggtgctggccgccgccgggagagcccggggcagagcagaggtgctcatcagcactgtaggcccggaagactgtactgaaacagcaaggtgtcctggctctccggccttacctccaaaagcagccccagcccagccccgctga

SEQ ID NO: 153272 - DNA, 2583 bp, Homo sapiens
  Payload ID: 10152
  Gene Symbol: MARS
  Gene Name: methionyl-tRNA synthetase
  ENST ID: ENST00000628866
  CDS Start-End: 24-311
atcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctat

SEQ ID NO: 153273 - DNA, 3019 bp, Homo sapiens
  Payload ID: 10153
  Gene Symbol: MARS2
  Gene Name: methionyl-tRNA synthetase 2, mitochondrial
  Uniprot ID: Q96GW9
  ENST ID: ENST00000282276
  CDS Start-End: 38-1819
agaacgccgcctcctccgcttgcggccggtctgcaccatgctgcgaacgtccgtcctccgcctgctaggacgcacgggggctagtaggctgtctctcctggaggacttcggcccacgctactacagttcgggctccctcagtgccggcgatgatgcttgtgatgtgcgcgcctacttcactacacccattttctacgtgaacgcggcgccgcacatcgggcacctgtactcggcactactggcggacgccctatgccgccaccgtcgcctccgaggtcccagcacggccgccacgcgattctccactggtaccgacgagcacgggctgaagattcagcaggcagcagctaccgcgggcctggccccgaccgagctgtgcgaccgagtctctgagcagttccagcagcttttccaggaggccggtatctcctgcacagatttcatccgcaccacggaggcccggcaccgggtggctgtgcagcacttctggggggtgcttaagtcccgcggtctgctctacaagggcgtctatgaaggttggtattgcgcttccgacgagtgcttcctgcctgaggccaaggtcacccagcagccgggcccatcgggggattcgtttcctgtatctctcgagagcgggcatccagtctcctggaccaaggaagaaaactacattttcaggctttcccagttccggaagccactccagcggtggctgcggggcaaccctcaggcgatcacccccgaaccatttcatcacgtagttcttcagtggctggacgaggagctgcccgacctgtccgtgtctcgcagaagtagccacttgcactggggcattccggtgcccggggatgattcgcagaccatctatgtatggctggatgccctggtcaactacctcactgtaattggctacccaaatgctgagttcaaatcttggtggccggccacctctcatatcataggtaaggacattctcaaattccatgccatctattggcctgccttcctgttaggggccggcatgagcccgccacagcgcatctgtgtccattcccactggacagtctgtggccaaaagatgtccaagagcttgggcaacgtggtggatcctaggacttgccttaaccgctataccgtggatggcttccgctactttctccttcggcagggcgtccccaactgggactgtgactactatgatgaaaaggtggttaagttgctgaactccgagctggcagatgccttgggaggtctcttgaaccgatgcactgccaaaagaataaatccttctgagacctacccagccttctgcactacctgcttccctagtgagccagggttggtggggccgtcagttcgtgctcaggcagaggattatgctctggtgagcgcagtggccactttgccaaagcaggtagcagaccactatgataactttcggatatataaggctctggaggccgtgtccagctgtgtccggcaaactaatggttttgtccaaaggcatgcaccatggaagctgaactgggagagcccagtggatgctccctggctgggtactgtgcttcatgtggccttggaatgtttgcgagtctttgggactttgctgcagcctgtcaccccaagcctagctgacaagctgctgtctaggctgggggtctctgcctcagagaggagtcttggagagctctatttcttgcctcgattctatggacatccatgcccttttgaagggaggaggctgggacctgaaactgggcttttgtttccaagactagaccagtccaggacttggctggtgaaagcccaccggacctagaaactcagttcttaccggcttgtggtaaaaaagcaaatgtgttatctttttattttttattttcaggaaagttatactagtattttcttaagtgtggaatcaaatgagcacataagctgtgtccctgtgaaaagaggtttgtagcctttcaggtgcctgctcctattcatttctctgtgaccattgatcactgtcctttgtgcattgtgtgtctaagatgtcttcaggggaaagatgggtaagagacagtgttgctaatgctgttccttctttgtgcctccttccaaaccacagttatttgcccaaactacctctcgtggctggtttttcattggcctggcctctgcttctcaggctaattagtgactcctttctttgagggtcagggttggaggccccttactggtggttttacagggggatcctactttgttacacatgttgggtttcctgataaaaagagagtattttattaaacccttgaaccagtgtcctagaccagatgatttttgcccatgtgtatccccatttaaattcctacaactaagtctccctgctttgttaatagtccaacagttgggttgtgtaacatcacacttcaaccggtagatggctctaatctcacacatttacttactaaagattgaggattcggaatatttagaataaattagttttctgctttctaattttgcagatctttacatttttattgcttttcttaaaataagggatagctttgcaaccactattgttttaatggaaagcaaaaaacccccccaaacttatcagaatcctcgttctttttcagactactgaaaaatgacatttactctgttaaatgtttaataagtgaataagtaaatgtatcaagttgtttatataataaattataaaactcttgaggcacttggtatgttaaaaattttaaactttagtaacattaggttacaggtatgatttaaaaatttgtaaatagttcaaaagggcaatgttttctttatatttcttatagtcttaattttgttatccatgtgcataatttacctcatgatttcttttggtcaatcaggatctttaatacaatatagaaattgtgtaatagttattataaatgttaatacacaactttcaggtaattttaactgattatttcttttgctcttttaacttaagttattaaagtttaaaagttcgtaa

SEQ ID NO: 153274 - DNA, 10505 bp, Homo sapiens
  Payload ID: 10154
  Gene Symbol: MECP2
  Gene Name: methyl CpG binding protein 2
  Uniprot ID: P51608
  ENST ID: ENST00000303391
  CDS Start-End: 251-1711
gcgcgacgtcggccgtgcggggtcccggcgtcggcggcgcgcgcgctccctcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtga

SEQ ID NO: 153275 - DNA, 784 bp, Homo sapiens
  Payload ID: 10154
  Gene Symbol: MECP2
  Gene Name: methyl CpG binding protein 2
  ENST ID: ENST00000369957
  CDS Start-End: 159-272
ggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagctgcaagatgggattcagatctgttctcaagcctgtcgttccaggacccaggagggagaagcagctgccaggggaagtctcttcgtaggcggaggtcaggagtccaagaggagtgagcagagtcacagaagcctcttaaagcctcttcttcccccatcccatcaacacggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaa

SEQ ID NO: 153276 - DNA, 1174 bp, Homo sapiens
  Payload ID: 10154
  Gene Symbol: MECP2
  Gene Name: methyl CpG binding protein 2
  ENST ID: ENST00000407218
  CDS Start-End: 25-579
gctgtggtaaaagccgtccggaaaatggccgccgccgccgccgccgcgccgagcggaggaggaggaggaggcgaggaggagagactggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggactt

SEQ ID NO: 153277 - DNA, 1729 bp, Homo sapiens
  Payload ID: 10154
  Gene Symbol: MECP2
  Gene Name: methyl CpG binding protein 2
  Uniprot ID: P51608
  ENST ID: ENST00000453960
  CDS Start-End: 100-1596
gagggcggggcgcgacgtcggccgtgcggggtcccggcgtcggcggcgcgcgcgctccctcctctcggagagagggctgtggtaaaagccgtccggaaaatggccgccgccgccgccgccgcgccgagcggaggaggaggaggaggcgaggaggagagactggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaa

SEQ ID NO: 153278 - DNA, 413 bp, Homo sapiens
  Payload ID: 10154
  Gene Symbol: MECP2
  Gene Name: methyl CpG binding protein 2
  ENST ID: ENST00000415944
  CDS Start-End: 265-413
gcaggaacaagtaggtggggattattatccacaaaagggactagacattgtgttctgggtcccacaactcatcataaagaggtggttatagttcccatcaggagccgtgggtaggggactgtgcgtccagcagcacccgaggctcttcggcgccagaggctctaaggctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagc

SEQ ID NO: 153279 - DNA, 603 bp, Homo sapiens
  Payload ID: 10154
  Gene Symbol: MECP2
  Gene Name: methyl CpG binding protein 2
  ENST ID: ENST00000611468
  CDS Start-End: 97-603
cagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagggagcccctcccggcgagagcagaaaccacctaa

SEQ ID NO: 153280 - DNA, 10237 bp, Homo sapiens
  Payload ID: 10154
  Gene Symbol: MECP2
  Gene Name: methyl CpG binding protein 2
  ENST ID: ENST00000619732
  CDS Start-End: 227-1756
ccggcgtcggcggcgcgcgcgctccctcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaattt

SEQ ID NO: 153281 - DNA, 1071 bp, Homo sapiens
  Payload ID: 10154
  Gene Symbol: MECP2
  Gene Name: methyl CpG binding protein 2
  ENST ID: ENST00000622433
  CDS Start-End: 97-1071
cagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagttctatccgatctgtgcaggagaccgtactccccatcaagaagcgcaagacccgggagacggtcagcatcgaggtcaaggaagtggtgaagcccctgctggtgtccaccctcggtga

SEQ ID NO: 153282 - DNA, 261 bp, Homo sapiens
  Payload ID: 10154
  Gene Symbol: MECP2
  Gene Name: methyl CpG binding protein 2
  ENST ID: ENST00000630151
  CDS Start-End: 137-261
ctgtcccggcaagcccctgtgcgtgtgcatcattccgggctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaa

SEQ ID NO: 153283 - DNA, 1712 bp, Homo sapiens
  Payload ID: 10154
  Gene Symbol: MECP2
  Gene Name: methyl CpG binding protein 2
  ENST ID: ENST00000628176
  CDS Start-End: 233-751
ggggtcccggcgtcggcggcgcgcgcgctccctcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttca

SEQ ID NO: 153284 - DNA, 2470 bp, Homo sapiens
  Payload ID: 10155
  Gene Symbol: MBD4
  Gene Name: methyl-CpG binding domain 4 DNA glycosylase
  Uniprot ID: O95243
  ENST ID: ENST00000249910
  CDS Start-End: 177-1919
ggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggtgagaaaatatttcaagaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatccaaaaaaaatacggcttttccaatgatgaaatataatcagaagatgaaaaatagttctaaactatcaataatacaaagcaaatttctatcagccttgctaaagctaggggcccactaaatatttttatcggctaggcgtggtggtgcatgcctgtaatctcggaaggctgaggcaggaggatcatttgagctcatgagggcccaggaggtcaaggcttcagtgagccatgatcatgccactgcactccagtctggatgacagagagagaccctgtctcaaaaaatatatatttaaaaaataaaaataaaagctgaccccaaagac

SEQ ID NO: 153285 - DNA, 1684 bp, Homo sapiens
  Payload ID: 10155
  Gene Symbol: MBD4
  Gene Name: methyl-CpG binding domain 4 DNA glycosylase
  Uniprot ID: O95243
  ENST ID: ENST00000393278
  CDS Start-End: 347-1135
cttgctccgagcgcgcatgtccgaaagggaaagccagaaaagcagcaaaagcaatggtggcactggagcccctaaggcgccagcgcaaccagagcgcgagcgattggtcggggcgtgtgggggcggtgcgtcttcctcgagaatggatttgattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatccaaaaaaaatacggcttttccaatgatgaaatataatcagaagatgaaaaatagttctaaactatcaataatacaaagcaaatttctatcagccttgctaaagctaggggcccactaaatatttttatcggctaggcgtggtggtgcatgcctgtaatctcggaaggctgaggcaggaggatcatttgagctcatgagggcccaggaggtcaaggcttcagtgagccatgatcatgccactgcactccagtctggatgacagagagagaccctgtctcaaaaaatatatatttaaaaaataaaaataaaagctgaccccaaag

SEQ ID NO: 153286 - DNA, 2478 bp, Homo sapiens
  Payload ID: 10155
  Gene Symbol: MBD4
  Gene Name: methyl-CpG binding domain 4 DNA glycosylase
  Uniprot ID: O95243
  ENST ID: ENST00000429544
  CDS Start-End: 197-1921
gattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactgaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatccaaaaaaaatacggcttttccaatgatgaaatataatcagaagatgaaaaatagttctaaactatcaataatacaaagcaaatttctatcagccttgctaaagctaggggcccactaaatatttttatcggctaggcgtggtggtgcatgcctgtaatctcggaaggctgaggcaggaggatcatttgagctcatgagggcccaggaggtcaaggcttcagtgagccatgatcatgccactgcactccagtctggatgacagagagagaccctgtctcaaaaaatatatatttaaaaaataaaaataaaagctgaccccaaagacaaataa

SEQ ID NO: 153287 - DNA, 2194 bp, Homo sapiens
  Payload ID: 10155
  Gene Symbol: MBD4
  Gene Name: methyl-CpG binding domain 4 DNA glycosylase
  Uniprot ID: O95243
  ENST ID: ENST00000507208
  CDS Start-End: 203-1921
ggatttgattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggtgagaaaatatttcaagaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgaggctcactcccatccataattcagcacatttggtctctgaggcaaaataagtccaccattatggttaagactatttattggatacaaatgctattacagtcacaaacaattgtgttcctggctgcggggaagcgggtggcatgtgggttttggggtttttgatcagtaggcgctcccaagtccacaaagaccagtccagcggcgtggcctctgactcatctccagtggtttgtcacctctggccctgttcctgtcattccctatttgtgtgctatctctaagcctgacgtggttttcctcctgtcaaaagtacaccactacag

SEQ ID NO: 153288 - DNA, 576 bp, Homo sapiens
  Payload ID: 10155
  Gene Symbol: MBD4
  Gene Name: methyl-CpG binding domain 4 DNA glycosylase
  ENST ID: ENST00000509828
  CDS Start-End: 95-253
cggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttcaagctcatctgttatgcatagctttgcacttc

SEQ ID NO: 153289 - DNA, 2099 bp, Homo sapiens
  Payload ID: 10155
  Gene Symbol: MBD4
  Gene Name: methyl-CpG binding domain 4 DNA glycosylase
  Uniprot ID: O95243
  ENST ID: ENST00000503197
  CDS Start-End: 175-1797
cggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggtgagaaaatatttcaagaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatccaaaaaaaa

SEQ ID NO: 153290 - DNA, 3259 bp, Homo sapiens
  Payload ID: 10156
  Gene Symbol: MBD1
  Gene Name: methyl-CpG binding domain protein 1
  Uniprot ID: Q9UIS9
  ENST ID: ENST00000269468
  CDS Start-End: 438-2255
aaagcgcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgtggctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccactt

SEQ ID NO: 153291 - DNA, 2820 bp, Homo sapiens
  Payload ID: 10156
  Gene Symbol: MBD1
  Gene Name: methyl-CpG binding domain protein 1
  Uniprot ID: Q9UIS9
  ENST ID: ENST00000353909
  CDS Start-End: 140-1810
gcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgtggctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttacttac

SEQ ID NO: 153292 - DNA, 2980 bp, Homo sapiens
  Payload ID: 10156
  Gene Symbol: MBD1
  Gene Name: methyl-CpG binding domain protein 1
  Uniprot ID: Q9UIS9
  ENST ID: ENST00000269471
  CDS Start-End: 438-2198
aaagcgcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgtggctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccactt

SEQ ID NO: 153293 - DNA, 3091 bp, Homo sapiens
  Payload ID: 10156
  Gene Symbol: MBD1
  Gene Name: methyl-CpG binding domain protein 1
  Uniprot ID: Q9UIS9
  ENST ID: ENST00000347968
  CDS Start-End: 438-2087
aaagcgcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgtggctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccactt

SEQ ID NO: 153294 - DNA, 2956 bp, Homo sapiens
  Payload ID: 10156
  Gene Symbol: MBD1
  Gene Name: methyl-CpG binding domain protein 1
  Uniprot ID: Q9UIS9
  ENST ID: ENST00000339998
  CDS Start-End: 140-1792
gcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgtggctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccactt

SEQ ID NO: 153295 - DNA, 2434 bp, Homo sapiens
  Payload ID: 10156
  Gene Symbol: MBD1
  Gene Name: methyl-CpG binding domain protein 1
  Uniprot ID: Q9UIS9
  ENST ID: ENST00000382948
  CDS Start-End: 438-2255
aaagcgcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtattaccaccttgctcttgactggaaatgcaactgtggttaccacctgtgctgcaggtccgtcctggttccctgatttgtgtttcctgttctgcctggatcctgattctcagaaaccagttactggacttctgatccacatcctga

SEQ ID NO: 153296 - DNA, 1512 bp, Homo sapiens
  Payload ID: 10156
  Gene Symbol: MBD1
  Gene Name: methyl-CpG binding domain protein 1
  Uniprot ID: Q9UIS9
  ENST ID: ENST00000398488
  CDS Start-End: 1-1512
atggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtag

SEQ ID NO: 153297 - DNA, 1845 bp, Homo sapiens
  Payload ID: 10156
  Gene Symbol: MBD1
  Gene Name: methyl-CpG binding domain protein 1
  Uniprot ID: Q9UIS9
  ENST ID: ENST00000398493
  CDS Start-End: 164-1813
gcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaag

SEQ ID NO: 153298 - DNA, 2178 bp, Homo sapiens
  Payload ID: 10156
  Gene Symbol: MBD1
  Gene Name: methyl-CpG binding domain protein 1
  ENST ID: ENST00000398495
  CDS Start-End: 19-1719
ctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggcaccttgctcaccgcctgcgtcgccgtcatcagagatgtcagcgacgcactcccctggctgtggctcccccaactggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagagatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgcta

SEQ ID NO: 153299 - DNA, 2473 bp, Homo sapiens
  Payload ID: 10156
  Gene Symbol: MBD1
  Gene Name: methyl-CpG binding domain protein 1
  Uniprot ID: Q9UIS9
  ENST ID: ENST00000457839
  CDS Start-End: 130-2022
aggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggcaccttgctcaccgcctgcgtcgccgtcatcagagatgtcagcgacgcactcccctggctgtggctcccccaactggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaagg

SEQ ID NO: 153300 - DNA, 749 bp, Homo sapiens
  Payload ID: 10156
  Gene Symbol: MBD1
  Gene Name: methyl-CpG binding domain protein 1
  ENST ID: ENST00000590215
  CDS Start-End: 335-469
ctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctca

SEQ ID NO: 153301 - DNA, 1611 bp, Homo sapiens
  Payload ID: 10156
  Gene Symbol: MBD1
  Gene Name: methyl-CpG binding domain protein 1
  Uniprot ID: Q9UIS9
  ENST ID: ENST00000591535
  CDS Start-End: 1-1611
atggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtag

SEQ ID NO: 153302 - DNA, 2532 bp, Homo sapiens
  Payload ID: 10156
  Gene Symbol: MBD1
  Gene Name: methyl-CpG binding domain protein 1
  Uniprot ID: Q9UIS9
  ENST ID: ENST00000585672
  CDS Start-End: 123-1826
ggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtattaccaccttgctcttgactggaaatgcaactgtggttaccacctgtgctgcaggtccgtcctggttccctgatttgtgtttcctgttctgcctggatcctgattctcagaaaccagttactggacttctgatccacatcctgaccctggtccactgtgaccctcagactcttaattatgctccaccaggtcgtgccactgccccactagtccatttgatctgcccccatcctaggatatcctgagtctaagccctggtttctgccaatggcaaataggaagattttattaacaggttttaaaaaattattattattactggttatttggtttgacaaggcacttaggctccctgagctttgccttagctggaaaataaggatagtattacttgctattctatcaaccctgtaagatatttgcggccacgcgcggtagcgcaccctgtaattccaacactttgggaggccggcgggaggggcagtggggaggatcgcttgaacccaggagcaggagttccagcctgagcaacatagcgggaccccctgtctcttcaaaatttgtttttaaattagcagggcgtggtggcgcaggctttgtagtcccagatactctggaggctgaggcccaggaggacgaggctgcagggagccatgatcacgccactgcactccaccctgggcgacagagcgagaccttgtctcagaaaaaatctgtgaggttaaaaggctgtgtgtgtgaaaatatcttggaaattgtaaagaactacacaaatataa

SEQ ID NO: 153303 - DNA, 767 bp, Homo sapiens
  Payload ID: 10156
  Gene Symbol: MBD1
  Gene Name: methyl-CpG binding domain protein 1
  ENST ID: ENST00000589733
  CDS Start-End: 1-767
tgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgc

SEQ ID NO: 153304 - DNA, 836 bp, Homo sapiens
  Payload ID: 10156
  Gene Symbol: MBD1
  Gene Name: methyl-CpG binding domain protein 1
  ENST ID: ENST00000589541
  CDS Start-End: 1-723
tcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgag

SEQ ID NO: 153305 - DNA, 4905 bp, Homo sapiens
  Payload ID: 10156
  Gene Symbol: MBD1
  Gene Name: methyl-CpG binding domain protein 1
  Uniprot ID: Q9UIS9
  ENST ID: ENST00000591416
  CDS Start-End: 433-2250
gcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgtggctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccactta

SEQ ID NO: 153306 - DNA, 1952 bp, Homo sapiens
  Payload ID: 10156
  Gene Symbol: MBD1
  Gene Name: methyl-CpG binding domain protein 1
  ENST ID: ENST00000592060
  CDS Start-End: 1-1250
cccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagagccgagggtgtggagtatgccggggctgtcagacccaagaggattgtggccattgccccatctgccttcgccctccccgccctggtctcaggcgccagtggaaatgtgtccagcgacgttgcctacggcaccttgctcaccgcctgcgtcgccgtcatcagagatgtcagcgacgcactcccctggctgtggctcccccaactggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtattaccaccttgctcttgactggaaatgcaactgtggttaccacctgtgctgcaggtccgtcctggttccctgatttgtgtttcctgttctgcctggatcctgattctcagaaaccagttactggacttctgatccacatcctgaccctggtccactgtgaccctcagactcttaattatgctccaccaggtcgtgccactgccccactagtccatttgatctgcccccatcctaggatatcctgagtctaagccctggtttctgccaatggcaaataggaagattttattaacaggttttaaaaaattattattattactggttatttggtttgacaaggcacttaggctccctgagctttgccttagctggaaaataaggatagtattacttgctattctatcaaccctgtaagatatttgcggccacgcgcggtagcgcaccctgtaattccaacactttgggaggccggcgggaggggcagtggggaggatcgcttgaacccaggagcaggagttccagcctgagcaacatagcgggaccccctgtctcttcaaaatttgtttttaaattagcagggcgtggtggcgcaggctttgtagtcccagatactctggaggctgaggcccaggaggacgaggctgcagggagccatgatcacgccactgcactccaccctgggcgacagagcgagaccttgtctcagaaaaaatctgtgaggttaaaaggctgtgtgtgtgaaaatatcttggaaattgtaaagaactacacaaat

SEQ ID NO: 153307 - DNA, 1761 bp, Homo sapiens
  Payload ID: 10156
  Gene Symbol: MBD1
  Gene Name: methyl-CpG binding domain protein 1
  Uniprot ID: Q9UIS9
  ENST ID: ENST00000588937
  CDS Start-End: 1-1761
atggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaa

SEQ ID NO: 153308 - DNA, 1945 bp, Homo sapiens
  Payload ID: 10156
  Gene Symbol: MBD1
  Gene Name: methyl-CpG binding domain protein 1
  Uniprot ID: Q9UIS9
  ENST ID: ENST00000587605
  CDS Start-End: 219-1826
atgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctg

SEQ ID NO: 153309 - DNA, 2179 bp, Homo sapiens
  Payload ID: 10156
  Gene Symbol: MBD1
  Gene Name: methyl-CpG binding domain protein 1
  Uniprot ID: Q9UIS9
  ENST ID: ENST00000585595
  CDS Start-End: 170-2062
attgtggctcagaacgctgacggggaggaatgaagggccctcaggccgataagggggaggaatggcggcgtcggaatactgacgaggagaaatggggggatttaggctgaggacgggaaggaatgcagctctgaactctgacaggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggcaccttgctcaccgcctgcgtcgccgtcatcagagatgtcagcgacgcactcccctggctgtggctcccccaactggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgagctgg

SEQ ID NO: 153310 - DNA, 2913 bp, Homo sapiens
  Payload ID: 10156
  Gene Symbol: MBD1
  Gene Name: methyl-CpG binding domain protein 1
  Uniprot ID: Q9UIS9
  ENST ID: ENST00000590208
  CDS Start-End: 348-2315
gatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgtggctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaa

SEQ ID NO: 153311 - DNA, 5188 bp, Homo sapiens
  Payload ID: 10157
  Gene Symbol: MBD2
  Gene Name: methyl-CpG binding domain protein 2
  Uniprot ID: Q9UBB5
  ENST ID: ENST00000256429
  CDS Start-End: 230-1465
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgattatattcacagactgattggaattctttctgttgaaaagcacacacaataaagaacccctcgttagccttcctctgatttacattcaactctgatccctgggccttaggtttgacatggaggtggaggaagatagcgcatatatttgcagtatgaactattgcctctggacgttgtgagaattgtgctttcaccagaatttctaagaatttctgctaaatatcacctagcatgtgtaattttttttccttgcctgtgacttggacttttgatagttctataagaataaggctttttcttcccttgggcatgagtcagatacacaaggacccttcaggtgttactagaaggcgtccatgtttattgttttttaaagaatgtttggcactctctaacgtccactagcttactgagttatcaggtgcaggtcagactcttggctacagtgagaggcagcttctagacagagttgcttaatgaaagggtttgtaatactttacaaaccattacctgtacctggcctggcctccaaaatattaacattctttttctgttgaaactcgcgagtgtaactttcataccacttgaatttattgatatttaattatgaaaactagcattacattattaaacgatttctaaaatcaaaacatacttaatctgataccaaggaagggagggagtggttataagcaaatgaaaacaaattttgagagacagagcaaaagtaaaatcattctatagaaaaggtgtgtttatttcttaactcttgagttcttttaaaattagaacctaaatgatgcagtcaggggtatgaccaattccacatgagtgtcacctgtacattttattaccactacctccagtttccaaggcagggaagaagaggggaatagtcaaagcaatatgactagctaggtttgggctgctgtttgggctgctgtttttcctggacttttatgccaaactacataaatacttcttggaattcctgatttacgctcaactttgatccctggaccctagggccattagtttccttgaagcagtcctgctggtggatgagcagggaaacttgtagaccctgggaagccaattggtagagggtgcctgcccgccccatcagactgtcccaactggggtgggggtgaggatcatagtgatttctttttaaaagctagtatgactagtgagaatggatgtccaagggcttttctcttcctcccccgagtccacgattcttcatttgtgatcagggttggggtaacttcaccttggtgatcatatattctttttacaaaccaatccagccaagatatatgtgcttttctaaacagcttgtaaaagcaaaaacacaatgtatacacatataaaactgatttttttttttttgcttatatactttgctcaggtggagaacaaggtatgaaagccattatatggtgtcccttggggaccatcccataagtccagggtgttcccaatatacccacaagacaacatgttcaaaacttcatcacctggtccccacaaacctaccaccctcttccattccctcactctggtaaaagcaagccatcttctccagttacgcaaggcagaagcccaggagtgagcacaatgctgccctttcccttgcttctgacttctcatcaatcctattagaactactgactgcaccccacctctcctccatccccacgatcactgccttcatatgaactgcctttcctgtcctctggactttcagtggcttccttttttgctcacctgtccactttcttccccttccctctctccatccctccacatagtcatcagaaagatcatcaaaacaggcaaatgtgactgtattatttccctcacttatctttgtatgcagtttagagtgatttttaagagcacacactttgaaattaggagaacctgtgtctgaatcctgatttttgccatttgtgtgacttgtcaggttatttaatctctttgagcctgtccctcctcagtgaaataggaataataatacctacctcatagagttgttgtgaggattcagtgagatagactgtttctaaagtgtgtagcacagtgcctggcacatagtgggtgctcacattggagcacactattgtcgctatccctgcaggtgtgagttttacatcctttccaagaggcatttgctaataaccctaactaccgcctatccctgtgacactattttctgcctcagcaccctatttcttttgtagacattttctaagtctgtattttatttatttgttggctttttgtctatttctctactagaatgtaagctccatgagagcaaggatgtgtttgtctgatttcccgttacagccccagcacttagctgagtgactggcacctagtaagcactcagtaactgtttgctgaataaatggaagaatggtcaaaaggctcttcttgatctgatccctgcttgtctgtctggcctcatgctgccactattcctcactgcaccttcagctcaagaaaaacctctttacttgcttctttgaagtgccccttgggcctctgtgtctttgtacctgttgttccctttgcctgaaacaccctttgcctgcccgtctacatggtgaattcctaatcattgatgaagtctcagctcaatggctacctcctctgtgaagctgtccctgatttcttcaggcagatgttctttcccgccttccctgttcccaccgcactttgtaaatacctccatggaagcactttattgtattgtattgtaatttttttttgcatgtctgtttctactattagactgtaagcaccgtaaaagcagagattgtgctttttcatcctcatgttccccgagcctagcccagtgcctggcacgtaatagcttgtcattaaatatttgttgaatgaatctgtgaatgaacaagagtcatgcagttggaaaagtgttagaagctgtatgtattataaaggaaagaaatgcccttggtggcttccagggtgtttttttttttttttttggtctaaagaggagatctagagagtgttatacaatctctttgaatataagattactcgtttggatttttaaaataatatagatcttcataaataattgcaaagatataaacaagctttgtgatttctcaaatgctatgaagtccaaaataaatatttgcactattagtatttccatagtaaatgctatgagaaaatgtacagcaataaattttgaagctttaaaactgtt

SEQ ID NO: 153312 - DNA, 1237 bp, Homo sapiens
  Payload ID: 10157
  Gene Symbol: MBD2
  Gene Name: methyl-CpG binding domain protein 2
  ENST ID: ENST00000398398
  CDS Start-End: 89-814
gcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagtttgtgtgcacttttctgctctagctgcgctggaacactcatcgtcctgcaccatggcatgcgctttcaagactctgcttgctcatacgctgtttgctctgcttggaatgtgcttacccccttccccttcatctggtgaactcctactcatccaagacccagcttcattgtctccatctctgggaagcctgccctgcatactccaggcagaaccaatcctttcctccataatgcttccctggtgctttgccattgtatttgtgacttgtttgtctgcttcagctagactgtgagctccatgagggcagggaccatgtctttttttgcttttgcacacggtaggtacttaatattgctttatgtttatttgatttaccatccacctcattctagaagtgtatagtggtaataaatgtttattaaataaataaattataccgtacatta

SEQ ID NO: 153313 - DNA, 701 bp, Homo sapiens
  Payload ID: 10157
  Gene Symbol: MBD2
  Gene Name: methyl-CpG binding domain protein 2
  ENST ID: ENST00000578272
  CDS Start-End: 1-219
aacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcaggtgagccaggaaaacagaagatatttggagccacattggatcagcatcttgctatagatgtctcaagatttgaagttctaaacttgctttactgttggtccccaagagattcaacaggggccatcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaaact

SEQ ID NO: 153314 - DNA, 1182 bp, Homo sapiens
  Payload ID: 10157
  Gene Symbol: MBD2
  Gene Name: methyl-CpG binding domain protein 2
  Uniprot ID: Q9UBB5
  ENST ID: ENST00000583046
  CDS Start-End: 59-967
cgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagctgcgctggaacactcatcgtcctgcaccatggcatgcgctttcaagactctgcttgctcatacgctgtttgctctgcttggaatgtgcttacccccttccccttcatctggtgaactcctactcatccaagacccagcttcattgtctccatctctgggaagcctgccctgcatactccaggcagaaccaatcctttcctccataatgcttccctggtgctttgccattgtatttgtgacttgtttgtctgcttcagctagactgtgagctccatgagggcagggaccatgtctttttttgcttttgcacacggtaggtacttaatattgctttatgtttatttgatttaccatccacctcattctagaagtgtatagtggtaataaatgtttattaaataaataaattataccgtacatt

SEQ ID NO: 153315 - DNA, 5518 bp, Homo sapiens
  Payload ID: 10158
  Gene Symbol: MBD3
  Gene Name: methyl-CpG binding domain protein 3
  Uniprot ID: O95983
  ENST ID: ENST00000156825
  CDS Start-End: 171-950
caaagccggcgcgcgcccggctgggggcggagggcgggggcccgcgggccggaacagccgcggcaagtggcggcggcggcagcggcagcggaggcagctgaggcggcggcggcgagtgggggtccgggcggcggcggcgggcccggcggcgggccgaggagccgggcgcaatggagcggaagagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcatgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttggagcctggagttcggtgcgtccgctagactttggtgcccacgtttgagcttctgtctttggttgggtgatgaaaggctgaaagcggtgtggggacagggccagcaggtcccccaacctcgcggacattcacaacccaagagtcaggcttaggggtattcagagaagaccaggccggcctgggcatctgtgggcaagggccgtgccccctgaggtgccgctggctcagcctagggatcgtgggtcttggccctgctgccccggtgaggaagatgggctggggctcagacccagcaccgctccttccaaaggaagggaagcaggaggggctgcctggcagggagggccccccaggtcctcaggtcctgcacagccgctgcagggaggggagctgtgccccgggaccctggacttcagctcactagccatggccactggaagctgctttctggacctgaaggctgggaggccaccctcccctcatctgcccggcactcagagacactctgtttccctcttcccatctcccactgtgtccctgtctcccttggtctctctctgtctctgtctatccctgtctctatctctccctcttgtctctctcttgcgccgtctccctctctgtccctctttgtttcttgctctctctcctgtctctctccctcggtctctgtctctgtctcttgctgtctctccctctctgtcgcagcccagcttcctgtcactgacagaccccgatcagtccctctgatcccggggttctggccatgtcctggccttggtctgagatgtgatgatccctacccctgccacagggccctccccactggaagcccatccaggccctgggctgtcgctgttgacgaagcttgagggtcctttcctctctccctgaaaccttggggacccccacaggccaaggcaatactggcctttgctagaggtcgtgcccggtgagaagtgagttgtaggcgtgggcacctgaggggccagcccagtgctcaggccctcgtcaaattccctgccctggaaaagtctcagaccctcaggctgaaccccctgggcgcaccgaggctccacactccagccccagaacccagacctggcatggggcggggaagcctgagctcccaatgctgggatctttcgtgggggcctcatgaccagcctgccctgtgcggtgcctggccccatcctcaaaggccacttggctgcccccagccccgcccatgtctcagccccaagaccttctgggactttttttttttttagacaagagtttcgctcttctttcgctcttgttgcacaggctggagtgcagtggcgtgatctgggctcactgcaacctccaccttctgggttcaagcctcagcctcccgagtagccaccacgcccagctaatttttgtatttttaatagagacagggtttcaccatgttggccagtctggtctggaactcctaacctcaggtgatccgcccgccccagcttcccaaattgccgggattacaggtgtgaaccaccatggcagcccttctggcacttgccagcagcagcaagagcctcacgtgtcccccgcctcccctcagaccaagctccccaccgctgccgccacagagggtaccagggaggagaggctcaggacccccgtggcgaggatgcacctcccagccctcggcccagccacacggaccacagggctcccgagtctcagcaacaccagctaaggggcatcatgcctctcctgccacacccagggcccgtgccttgctgtccctgcagcccccagacccaggcagacagggacagcccttctgaccaccgcacacactcgccaccgcaaagatccccggggatgcccctcgcctgtgtgtgtccctcatggctgtcacagcaaatctccaggagcccggaggtgcccatggaaaacacccccagcttccggaacgttctttcggacagggccataccggagcaagactcagctttctggtagcgggtggctgggcactgcctgtgagattctgtcacactcgctccagattcaaggggtccaaaaagtgtaaacaagtcaagtgcccatccagggatgaacgaacacagcccggcccggccacaccatggagcaggactcggccatgaacaggaaccaggctctgacaccggccacggcgcagatgcccctggaggagtccaccctcagcaagagacacacagacaccgacacggcgtgcaatcccatttgtgtgaatgtccaggacaggccgattcagagacaggaaggggacacgtgggtgccagtgactggggattatggggactgggggaaatggctaaagggcacccacaaaagttaatgataatgttccacagttttttttttgagatggagtctcactcttgtcacccaggctggagtgcaatggtgtgatctctgctcactgcaagctctgcctcctgggttcacgccattctccctcctcagcctcccaagtagctgagattacaggcatatgccaccacccccagtagagacggggtttcaccatgttagccaggctggtcacgaactcctgacctcaagtgatcccccacctcggcctcccaaagtgctgggattacaggcatgagccaccgtgcctcaccagaattgtgtacttttttttcttcttcttcttcggcatggagtttcgctcttgttgcccaggctggagtgcaatggtgcaaacttggctcaccgcaacctcctcctcccgggttcaatagattctccagcctcagcctgctgagtagctgagattacgggcgcccgccaccacacccagctaatctttgtacttttagtagagacagggtttcaccatgttggccacgggcaaaagaattttgttgagggcaaataatatgagaccacaaaactgccttccctgctcagttttaattttcacagttttaatttttagccttctctggttaccaaaataaccacgctcacggccgttcatttgaagatatttccagttaacgtgtgtgaagtgggttttttgagatgtaatttacaagcaataaaatgctcctgtctctgc

SEQ ID NO: 153316 - DNA, 2439 bp, Homo sapiens
  Payload ID: 10158
  Gene Symbol: MBD3
  Gene Name: methyl-CpG binding domain protein 3
  Uniprot ID: O95983
  ENST ID: ENST00000434436
  CDS Start-End: 78-953
gcagctgaggcggcggcggcgagtgggggtccgggcggcggcggcgggcccggcggcgggccgaggagccgggcgcaatggagcggaagaggtgggagtgcccggcgctcccgcagggctgggagagggaagaagtgcccagaaggtcggggctgtcggccggccacagggatgtcttttactatagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcatgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 153317 - DNA, 2782 bp, Homo sapiens
  Payload ID: 10158
  Gene Symbol: MBD3
  Gene Name: methyl-CpG binding domain protein 3
  ENST ID: ENST00000590550
  CDS Start-End: 375-1082
aaggatccgatgtggaggctggggctagggccagggtgtgaggatcggggccagtgctctgggtctggctggcgcccagatctaggggccagttgtggggtgctggggtctgggatgaaggtctggggtcacgccagggttggggtctggggctggggccagggcctgcctgggtttggggtcagggccgtgttggggtctggggctggggtcgcgacctgaagctggggctgggactgggtttgggtctgcggccgaggcctgggtttggggtctggggtccgcccggggcgccgaccgtcccgcctccccgcagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcaggtgctgcggggccacgggggctccctggagtcgggtcctggcagtggggactgcctggtgaacacagatgtgcttgggatgacgggtgcctcccaagagcttcccatctccctagaagagcccaagcgtccccgtcccgtggagtcgctaaagccagccctccctgtcctttccagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcatgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttggagcctggagttcggtgcgtccgctagactttggtgccca

SEQ ID NO: 153318 - DNA, 2379 bp, Homo sapiens
  Payload ID: 10158
  Gene Symbol: MBD3
  Gene Name: methyl-CpG binding domain protein 3
  ENST ID: ENST00000592012
  CDS Start-End: 152-709
gctggggctgggactgggtttgggtctgcggccgaggcctgggtttggggtctggggtccgcccggggcgccgaccgtcccgcctccccgcagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcatgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttggagcctggagttcggtgcgtccgctagactttggtgccca

SEQ ID NO: 153319 - DNA, 907 bp, Homo sapiens
  Payload ID: 10158
  Gene Symbol: MBD3
  Gene Name: methyl-CpG binding domain protein 3
  ENST ID: ENST00000592361
  CDS Start-End: 517-907
ctcactgaatgtggcgtcctcaaggtgcatccacgctgtggcctgtgtcagagcctcgctccttttcatggctgagtatgtcccatcgtgtggatgggcgtttgtccgttcatccattgaaggcgtctgggctgcttccaccttctggctcctggggacatccgtgtagaagtgatggtgtggatgcgtgctcatttttcgggcagatacctaagagtggcgtggccgggtcatctggaaactcagtgaagagctgtcaggcttttccaacatggctgttccatcttacatcccaaccatgatgacggtgtgttgggttgggtgcttgtcatcctgtagtgtgacctcatgtgacacacagggcaacccattggtgggtgtccttatgtcctggagaggatgagttgccggcgcttgtccatggcaggctgagagcagagccccgtgtctgagagcagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcaca

SEQ ID NO: 153320 - DNA, 415 bp, Homo sapiens
  Payload ID: 10158
  Gene Symbol: MBD3
  Gene Name: methyl-CpG binding domain protein 3
  ENST ID: ENST00000585903
  CDS Start-End: 1-124
cgacccgcagaaggcggtggaccagccgcgccagagtctcgctctgtcacccaggctggagtgcagtggcaggatcttaactcactacaacctctgcctcctggtttcaactgggttcaagtgatccttccacctcagcctcacaagtagctgggatttcagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtga

SEQ ID NO: 153321 - DNA, 568 bp, Homo sapiens
  Payload ID: 10158
  Gene Symbol: MBD3
  Gene Name: methyl-CpG binding domain protein 3
  ENST ID: ENST00000592965
  CDS Start-End: 467-568
ttgcgtgcgtgtgcgcccggcgcgcggaggcccagtgcgcgtgcgccgcttgttgggccgcatggctttcggccggccgttcagggactggctgccggacggcgactgcggcctttgttcgtgcgcgctgggccaggggcgcctggcggcggccagatgctaccggggggcaggggtggagggtgggctgtccctttggttcccgtgagacgcagggggtgccttcttggggcgctcctggggtggcgcggagcccgagggggtggccagccgggatttcggggagcagggctcatgggcggatcggggagggcgtgcgtgaaaatacgggttcttgggctcgccccagtcctgggaataagcgcctcagggtgactggtctcccacgcagcgttgctttttttaaagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaag

SEQ ID NO: 153322 - DNA, 583 bp, Homo sapiens
  Payload ID: 10158
  Gene Symbol: MBD3
  Gene Name: methyl-CpG binding domain protein 3
  ENST ID: ENST00000585967
  CDS Start-End: 142-583
agtgcgcgtgcgccgcttgttgggccgcatggctttcggccggccgttcagggactggctgccggacggcgactgcggcctttcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaacc

SEQ ID NO: 153323 - DNA, 748 bp, Homo sapiens
  Payload ID: 10159
  Gene Symbol: MBD3L1
  Gene Name: methyl-CpG binding domain protein 3-like 1
  Uniprot ID: Q8WWY6
  ENST ID: ENST00000305625
  CDS Start-End: 87-671
tccttgtcctgagaaggcaggcttcattgatcaatttgaccccatttcatgatttattttaatagtgtaagaggaaaagaagtgtgatggccaagagttcacagaggaagcaacgtgactgtgtaaaccaatgcaaatcaaagcctggcttgagcacctcaatccctttgagaatgtccagttacacattcaagaggccagtaacgagaattacaccccatcctggcaatgaggtcagataccatcaatgggaggagagcttggagaagcctcagcaggtctgctggcagaggagactgcagggactccaggcttacagcagtgcaggagaactttcaagcactttggatcttgccaataccttgcaaaaacttgtccctagttacacaggtggatctctgctggaggatcttgccagtggtctggagcactcctgccccatgccccaccttgcctgctcttcagatgcggtggagataattcctgcagagggagtgggtatctcgcagctcctctgcaaacaatttctggttactgaggaagatatcaggaaacaggaagggaaagtgaagacagtcagagagagactcgcaatagcactgattgcggatggactcgctaatgaggcagagaaagtgagagaccaagaaggccgtcctgaaaaacgctaagaaaaaaagggaagatagtgcagatgaaataaagtgtaatcctttattaacatctctttgcagtgtccccaatgagg

SEQ ID NO: 153324 - DNA, 872 bp, Homo sapiens
  Payload ID: 10159
  Gene Symbol: MBD3L1
  Gene Name: methyl-CpG binding domain protein 3-like 1
  Uniprot ID: Q8WWY6
  ENST ID: ENST00000595891
  CDS Start-End: 232-816
gttcggcgcttaggcgacaggcgcggcgggcgggagcggcggccgcgaaccccagccttgggcagaggtgttctagtttgcttagtgggcacaaagttgggccctggcctggggcagtagcggggtgatcatatgacggtggtagccatggcgtcacagagaacagggaccttccaagtttgaagttttacaaggcaggtgtgataagtgtgtaagaggaaaagaagtgtgatggccaagagttcacagaggaagcaacgtgactgtgtaaaccaatgcaaatcaaagcctggcttgagcacctcaatccctttgagaatgtccagttacacattcaagaggccagtaacgagaattacaccccatcctggcaatgaggtcagataccatcaatgggaggagagcttggagaagcctcagcaggtctgctggcagaggagactgcagggactccaggcttacagcagtgcaggagaactttcaagcactttggatcttgccaataccttgcaaaaacttgtccctagttacacaggtggatctctgctggaggatcttgccagtggtctggagcactcctgccccatgccccaccttgcctgctcttcagatgcggtggagataattcctgcagagggagtgggtatctcgcagctcctctgcaaacaatttctggttactgaggaagatatcaggaaacaggaagggaaagtgaagacagtcagagagagactcgcaatagcactgattgcggatggactcgctaatgaggcagagaaagtgagagaccaagaaggccgtcctgaaaaacgctaagaaaaaaagggaagatagtgcagatgaaataaagtgtaatcctttattaacatctc

SEQ ID NO: 153325 - DNA, 793 bp, Homo sapiens
  Payload ID: 10160
  Gene Symbol: MBD3L2
  Gene Name: methyl-CpG binding domain protein 3-like 2
  Uniprot ID: Q8NHZ7
  ENST ID: ENST00000381393
  CDS Start-End: 54-680
ccaagggctgtctgtgcctcaggagtggggtcagcaggaggaactctacagctatgggagaacctgcgttcacctcttttccaagcctgcctgttctggggaagctcaaaaggaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcgggcagaaatgctgacaggtggatgaagctcagtcttgggctttcggtccctttcttttaatgcccatcctcattcctactctgaattgtcacacttttcccttccccaccagttctttaataaaagtatttgaaaggc

SEQ ID NO: 153326 - DNA, 774 bp, Homo sapiens
  Payload ID: 10160
  Gene Symbol: MBD3L2
  Gene Name: methyl-CpG binding domain protein 3-like 2
  ENST ID: ENST00000616171
  CDS Start-End: 36-650
tcaggagtggggtcagcaggaggaactctacagctatgggagaacctgcgttcacctcttttccaagcctgcctgttctggggaagctcaaaaggaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcgggcagaaatgtgacaggtggatgaagctcagtcttgggctttcggtccctttcttttaatgcccatcctcattcctactctgaattgtcacacttttcccttccccaccagttctttaataaaagtatttgaaaggc

SEQ ID NO: 153327 - DNA, 775 bp, Homo sapiens
  Payload ID: 10161
  Gene Symbol: MBD3L3
  Gene Name: methyl-CpG binding domain protein 3-like 3
  Uniprot ID: A6NE82
  ENST ID: ENST00000333843
  CDS Start-End: 36-662
tcaagagtggggtcagcaagagaaactctacggctatgggagagcctgcgttcacctcttttccgagcccacctgttctggggaagctcaaaagaaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagggctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgctgacatgtagatgaagcgcagtcctgggctttcggtccctttcttttaatgcccatcctcattcctactctgaattgtcacacttttcccttccccaccagttctttaataaaagtatttgaaaggc

SEQ ID NO: 153328 - DNA, 774 bp, Homo sapiens
  Payload ID: 10161
  Gene Symbol: MBD3L3
  Gene Name: methyl-CpG binding domain protein 3-like 3
  ENST ID: ENST00000611585
  CDS Start-End: 36-650
tcaagagtggggtcagcaagagaaactctacggctatgggagagcctgcgttcacctcttttccgagcccacctgttctggggaagctcaaaagaaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagggctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgtgacatgtagatgaagcgcagtcctgggctttcggtccctttcttttaatgcccatcctcattcctactctgaattgtcacacttttcccttccccaccagttctttaataaaagtatttgaaaggc

SEQ ID NO: 153329 - DNA, 775 bp, Homo sapiens
  Payload ID: 10162
  Gene Symbol: MBD3L4
  Gene Name: methyl-CpG binding domain protein 3-like 4
  Uniprot ID: A6NDZ8
  ENST ID: ENST00000381394
  CDS Start-End: 36-662
tcaagagtggggtcagcaagagaaactctacggctatgggagagcctgcgttcacctcttttccgagcccacctgttctggggaagctcaaaagaaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcatcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgctgacatgtagatgaagcgcagtcctgggctttcggtccctttcttttaatgcccatcctcattcctactctgaattgtcacacttttcccttccccaccagttctttaataaaagtatttgaaaggc

SEQ ID NO: 153330 - DNA, 774 bp, Homo sapiens
  Payload ID: 10162
  Gene Symbol: MBD3L4
  Gene Name: methyl-CpG binding domain protein 3-like 4
  ENST ID: ENST00000619943
  CDS Start-End: 36-650
tcaagagtggggtcagcaagagaaactctacggctatgggagagcctgcgttcacctcttttccgagcccacctgttctggggaagctcaaaagaaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcatcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgtgacatgtagatgaagcgcagtcctgggctttcggtccctttcttttaatgcccatcctcattcctactctgaattgtcacacttttcccttccccaccagttctttaataaaagtatttgaaaggc

SEQ ID NO: 153331 - DNA, 778 bp, Homo sapiens
  Payload ID: 10163
  Gene Symbol: MBD3L5
  Gene Name: methyl-CpG binding domain protein 3-like 5
  Uniprot ID: A6NJ08
  ENST ID: ENST00000329753
  CDS Start-End: 35-661
caagagtggggtcagcaagagaaactctacggctatgggagagcctgcgttcacctcttttccgagcccacctgttctggggaagctcaaaagaaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcatcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgctgacaggtgggtgaagctcagtcctgggctttcggtccctttcttttaatgcccatcctcattcctactctgaattgtcacacttttcccttccccaccagttctttaataaaagtatttgaaaggcaaca

SEQ ID NO: 153332 - DNA, 774 bp, Homo sapiens
  Payload ID: 10163
  Gene Symbol: MBD3L5
  Gene Name: methyl-CpG binding domain protein 3-like 5
  ENST ID: ENST00000618571
  CDS Start-End: 36-650
tcaagagtggggtcagcaagagaaactctacggctatgggagagcctgcgttcacctcttttccgagcccacctgttctggggaagctcaaaagaaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcatcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgtgacaggtgggtgaagctcagtcctgggctttcggtccctttcttttaatgcccatcctcattcctactctgaattgtcacacttttcccttccccaccagttctttaataaaagtatttgaaaggc

SEQ ID NO: 153333 - DNA, 5920 bp, Homo sapiens
  Payload ID: 10164
  Gene Symbol: MBD5
  Gene Name: methyl-CpG binding domain protein 5
  ENST ID: ENST00000404807
  CDS Start-End: 130-5313
caatgcgttttgtacagtctgggaaaaactgtgctgcactggcccacttttgaaggccatcatgctctgtaatataaggatatcatcttattgctgatatctttggagagtccctagcagacacagaaaatgaatggaggcaaagagtgtgacggaggggacaaggaaggaggtcttccagctatacaagttcctgtgggttggcagcgtcgtgtggatcaaaatggagtgctttatgtcagtcccagtgggtctttgttatcttgcttggagcaggttaaaacatacctgcttactgatggaacatgcaagtgtggcttggaatgtcctcttattcttcccaaggtatttaattttgatcctggagctgctgtgaaacagagaaccgcagaagatgttaaggcagatgaagatgtcacaaagctatgcatacataaaagaaaaattattgcagtggccacacttcataaaagcatggaagccccacatccttctctggtgctcaccagtcccggaggaggaacaaatgcaactccagtagtaccttctcgggcagcaactccaagatcagtaagaaataagtctcatgaaggaattacaaattctgtaatgcctgaatgtaagaatcctttcaagttaatgattggatcatcaaatgccatgggaaggctatatgtacaagaactgcctggaagccaacaacaagaactccaccctgtctacccccgacagagattgggcagcagtgaacatggacagaaatctccattccgtggcagccatggaggcctgcccagcccagcgtcatcaggttcccagatatatggagatggttcaatctctccaaggactgacccacttggaagtcctgatgttttcacaagaagtaatcctggttttcatggagctcccaattctagtcctattcacctgaataggactcctctttctccaccttcagtaatgctacatggttctcctgtacagtcatcctgtgcaatggctggaaggactaatatacctctttccccaaccttgactacaaagagtccagtaatgaaaaaaccaatgtgtaatttttcaactaatatggaaataccacgagcaatgttccaccacaaaccaccccaaggcccacctccccctcctccaccttcttgtgctcttcagaaaaagccattaacatctgagaaagatccacttggcattcttgaccctattcctagtaaaccagtgaatcagaaccctgttatcattaatccaaccagtttccattcaaatgtccactctcaggtacctatgatgaatgtaagcatgcctcctgctgttgttcctttgccaagtaatctcccattgccaactgtaaaacctggtcacatgaatcatgggagtcatgtacaaagagttcagcattcagcttcaacctccctgtccccttctccagtgacatcccccgtgcacatgatggggactggaattggaaggattgaggcatcgccccaaagatcacgctcatcttccacatcatcagatcatggaaatttcatgatgccacctgtaggaccccaggccacttctagtggtattaaggttccacccaggtcaccaaggtcaacaatagggtccccaaggccatcaatgccatcaagcccttctaccaagtccgatggacatcatcagtacaaggatatccctaacccattaattgctggaataagtaatgtactaaataccccaagcagtgcagcttttcctactgcatctgccggaagtagttctgtaaagagtcagcctggtttgctgggaatgcctttaaatcagatcttgaaccagcacaatgctgcctcctttccagcaagtagtttactctcagcagcagccaaagcacagctagcaaatcaaaacaaacttgctggtaacaacagtagcagcagtagcaattctggagctgttgccggcagtggcaacactgaaggacatagcactttaaacaccatgttccctcctactgccaacatgcttctcccaacaggtgaagggcaaagtggtcgagcagcactaagagataagctgatgtctcagcaaaaagacgcattgcggaaaagaaaacaaccacctacgacagtgttgagtttgctcagacagtctcaaatggatagttctgcagttcctaaacctggacctgacttgctaaggaagcagggtcagggttcatttcccatcagttcaatgtctcagttactacagtctatgagttgtcaaagctctcacttgagtagcaatagtaccccgggttgtggggcctcaaatactgctttgccttgctctgctaaccagctgcattttacagatcccagtatgaactctagtgttcttcagaacatacctttaagaggggaagccgtgcactgccacaatgcaaacactaactttgttcacagtaacagtccagtccccaaccaccatcttgcaggtttaataaatcagattcaggctagcgggaactgtgggatgctcagtcagtcgggcatggctttaggaaattccttacatcccaatccacctcagtcaagaatttcaacgtcctccactccagtgataccaaacagcattgttagcagctataatcaaacaagttctgaagcaggcggttcaggaccatcatcctccatagccatagcgggcaccaaccaccctgccatcacaaagacaacatctgttcttcaagatggcgtcatagtcaccactgcagctggaaacccactgcagagtcagctacccattgggagtgattttccttttgttggccaggagcacgcacttcattttccatccaacagcacttcaaacaaccatcttccacaccccttgaaccccagcctcctcagttctctacctatctctttgccagtgaatcaacagcatctcctaaaccagaatctattaaatatcctccagccttcagcaggagaaggcaagtctgagatcaacctccaccctttaggttttctcaacccgaatgtaaacgctgctttagcttttctctccagtgacatggatgggcaggtattgcagcctgttcactttcagctcttagcagccttgcttcagaaccaagcccaagcagctgccatgcttcccctgccatctttcaatctgaccatctcagatcttttgcaacagcaaaatacccctttaccctcattaacacagatgacagccccaccagaccatttgccaagcaatcagtcagacaacagccgagctgagacccttttaaccagccccctggggaaccctttaccaagctttgcaggcagtgacactacttttaaccccctgttcctcccagctgtcaatggggcctcaggattaatgaccttgaatccccagctgttgggaggtgtcctgaactcggcatcggccaacaccgctaatcatccagaggtttccatagcaacctcctcccaggcaaccactaccacaaccactacatcatcagcagtggcagcactgactgtctcaacacttggtgggacagcagtggtgtcaatggcagaaacattgctgaatatatctaataatgctgggaatacacctggtccagctaaactcaacagtaactctgtggtgccacagctacttaaccctctactggggacaggtctacttggtgatatgtcatcaataaacaatactttgagtaaccatcaactgactcatctacagtcgctgttaaacaacaatcagatgtttcctccaaatcagcaacagcagcaacttctccaggggtaccagaatctccaggcgttccaaggacagtccacaattccttgcccagctaacaataaccccatggcttgtctgtttcagaactttcaggtgagaatgcaggaagatgcagctctcctaaacaaaagaataagcactcagcctgggctcacagcacttcctgagaatccaaacactacacttccaccttttcaagatacaccttgtgagttgcaaccgaggattgacccatctcttggtcaacaggtgaaggatggcctcgttgtgggtggcccaggtgatgcttccgtagatgccatttacaaagcagttgtcgatgcagccagcaaaggaatgcaggttgtcatcaccactgcagtcaacagtacaactcagatcagccccattccagctctgagtgccatgagtgccttcactgcctcaattggtgacccattaaatctctccagtgctgtcagtgcggtcattcatggacggaacatgggaggtgttgatcatgatggtaggctgaggaattcaagaggggctcggctgcccaagaatctagaccatgggaaaaatgtgaacgaaggagatgggtttgaatatttcaagtcagcaagttgccacacatccaaaaaacagtgggacggggagcaaagccccagaggggagcgaaacaggtggaagtacgaggaatttttagatcatccaggccatatccacagtagtccttgtcatgaaaggcccaacaatgtctctacactgccatttctgcctggggaacagcacccaatactgttaccaccaagaaactgtccaggggataaaattctagaggaaaatttcaggtataataactacaaaagaactatgatgagttttaaggagagactagagaacactgtggaaagatgtgcacacataaatgggaatagacctcgacagagtcggggatttggagagctgctaagcactgcaaagcaagacctggtcctagaggagcagtctccaagttcctcaaatagtttggaaaattctctggtcaaagactacatccattacaatggagactttaatgccaaaagcgttaatgggtgtgtgcctagcccttcagatgctaaaagcattagtagtgaagatgacctaaggaacccagactccccctcttcaaatgaattgatacattatagaccaaggacgttcaatgttggcgacttggtctggggccaaatcaaaggactgacttcctggcctggaaaattagtaagagaagacgacgttcacaattcatgtcaacaaagccccgaggaagggaaggtggagcccgagaagttgaagacactaacagaaggtttggaagcctacagccgtgtccggaaaaggaacagaaaaagtggaaagctaaataaccatttagaagctgctattcatgaggccatgagtgaactggacaaaatgtctgggactgtacaccaaatcccacagggtgacagacaaatgagaccccccaaacccaagaggaggaagatctccagataacagagactactccactaatgcgcagtgtttattaaaggaacatgcacagatgtatctgtatataggtattgatatagccacagttatatcaatatttagactatggcagatagctaccaccaccacagggtgctaaaagaaacagtgatacaaaatttttttgatcaggaaggataatgaatgctggaaaagccaatcaaagtctctgtgtgatgagagtgatcaatggtcaagagattactgagaaactctttttctataatactaaattgtgattataagaaatagtccaaatgtttctgaagaattttcaatgttgtatatagaaaatacagaatttcatggtgatatcagaaatgtaaatattgtacagtattgtcatgtacaagcgtacctaatgcacactttatcttttattgtacaaagaaatagtgtacaaaattctttggtttctatggagtacacctaccagagactaccagtgtaaagtgataaataaaaatacaacctaaatgcttttctatgataatgtaaaagatgctgtttttgtatttaacagcagagaaaaggcatgatgatgtaatatctgaattatgacatacactgc

SEQ ID NO: 153334 - DNA, 9512 bp, Homo sapiens
  Payload ID: 10164
  Gene Symbol: MBD5
  Gene Name: methyl-CpG binding domain protein 5
  Uniprot ID: Q9P267
  ENST ID: ENST00000407073
  CDS Start-End: 998-5482
aaccaaccagccacccgtcagagagggacatgcgcactccagggaaggcactcaaaagtggggggcaggaaagatgtacattgaagatgtcagtttctacatgtgggaagtagacattgaaggctttatggtttacagacaagatctttagaagataagcactaaaggaccaaggaaataaataccagaaatcaagaagagcacacactattttccttcatcaatccatagaaccctaatgcttctttagttccatcaaacacagaggaatgaccaccatggcagatggcaacagaggatgtcaacaattttttggagagagaagaggtactcccttatagggactcgtaaagacatagagcatctggaaattaactgcctccattacactgctgagtcacacacaacgcttgttatgttttcatcacttctctccagaaggctacattattggaattttgaagtcatgaaaacatcagatgaaccaacctgcaacaccttggattcagattggaagataaagagaaagtttaaagaatgtggcctataaaggcgggtacctggaaatattaaccgactcacactgtaaaaatgagaccagtttctaaacaatagagattgtcttagtacaacatcaaggttcaagacaaatgttgaactaaaaactttacactccccacccccacttcagacaggtaccagcattggtgaattatgattttccttagtcagaagcactcatttttacccatgtagaccatccttaggaattaaatattggttatttaatgtagattataatgggaagctgatttttttcacaatggcatatttcaaggacttggttccaaactgagctgaagcttcccaatgcgttttgtacagtctgggaaaaactgtgctgcactggcccacttttgaaggccatcatgctctgtaatataaggatatcatcttattgctgatatctttggagagtccctagcagacacagaaaatgaatggaggcaaagagtgtgacggaggggacaaggaaggaggtcttccagctatacaagttcctgtgggttggcagcgtcgtgtggatcaaaatggagtgctttatgtcagtcccagtgggtctttgttatcttgcttggagcaggttaaaacatacctgcttactgatggaacatgcaagtgtggcttggaatgtcctcttattcttcccaaggtatttaattttgatcctggagctgctgtgaaacagagaaccgcagaagatgttaaggcagatgaagatgtcacaaagctatgcatacataaaagaaaaattattgcagtggccacacttcataaaagcatggaagccccacatccttctctggtgctcaccagtcccggaggaggaacaaatgcaactccagtagtaccttctcgggcagcaactccaagatcagtaagaaataagtctcatgaaggaattacaaattctgtaatgcctgaatgtaagaatcctttcaagttaatgattggatcatcaaatgccatgggaaggctatatgtacaagaactgcctggaagccaacaacaagaactccaccctgtctacccccgacagagattgggcagcagtgaacatggacagaaatctccattccgtggcagccatggaggcctgcccagcccagcgtcatcaggttcccagatatatggagatggttcaatctctccaaggactgacccacttggaagtcctgatgttttcacaagaagtaatcctggttttcatggagctcccaattctagtcctattcacctgaataggactcctctttctccaccttcagtaatgctacatggttctcctgtacagtcatcctgtgcaatggctggaaggactaatatacctctttccccaaccttgactacaaagagtccagtaatgaaaaaaccaatgtgtaatttttcaactaatatggaaataccacgagcaatgttccaccacaaaccaccccaaggcccacctccccctcctccaccttcttgtgctcttcagaaaaagccattaacatctgagaaagatccacttggcattcttgaccctattcctagtaaaccagtgaatcagaaccctgttatcattaatccaaccagtttccattcaaatgtccactctcaggtacctatgatgaatgtaagcatgcctcctgctgttgttcctttgccaagtaatctcccattgccaactgtaaaacctggtcacatgaatcatgggagtcatgtacaaagagttcagcattcagcttcaacctccctgtccccttctccagtgacatcccccgtgcacatgatggggactggaattggaaggattgaggcatcgccccaaagatcacgctcatcttccacatcatcagatcatggaaatttcatgatgccacctgtaggaccccaggccacttctagtggtattaaggttccacccaggtcaccaaggtcaacaatagggtccccaaggccatcaatgccatcaagcccttctaccaagtccgatggacatcatcagtacaaggatatccctaacccattaattgctggaataagtaatgtactaaataccccaagcagtgcagcttttcctactgcatctgccggaagtagttctgtaaagagtcagcctggtttgctgggaatgcctttaaatcagatcttgaaccagcacaatgctgcctcctttccagcaagtagtttactctcagcagcagccaaagcacagctagcaaatcaaaacaaacttgctggtaacaacagtagcagcagtagcaattctggagctgttgccggcagtggcaacactgaaggacatagcactttaaacaccatgttccctcctactgccaacatgcttctcccaacaggtgaagggcaaagtggtcgagcagcactaagagataagctgatgtctcagcaaaaagacgcattgcggaaaagaaaacaaccacctacgacagtgttgagtttgctcagacagtctcaaatggatagttctgcagttcctaaacctggacctgacttgctaaggaagcagggtcagggttcatttcccatcagttcaatgtctcagttactacagtctatgagttgtcaaagctctcacttgagtagcaatagtaccccgggttgtggggcctcaaatactgctttgccttgctctgctaaccagctgcattttacagatcccagtatgaactctagtgttcttcagaacatacctttaagaggggaagccgtgcactgccacaatgcaaacactaactttgttcacagtaacagtccagtccccaaccaccatcttgcaggtttaataaatcagattcaggctagcgggaactgtgggatgctcagtcagtcgggcatggctttaggaaattccttacatcccaatccacctcagtcaagaatttcaacgtcctccactccagtgataccaaacagcattgttagcagctataatcaaacaagttctgaagcaggcggttcaggaccatcatcctccatagccatagcgggcaccaaccaccctgccatcacaaagacaacatctgttcttcaagatggcgtcatagtcaccactgcagctggaaacccactgcagagtcagctacccattgggagtgattttccttttgttggccaggagcacgcacttcattttccatccaacagcacttcaaacaaccatcttccacaccccttgaaccccagcctcctcagttctctacctatctctttgccagtgaatcaacagcatctcctaaaccagaatctattaaatatcctccagccttcagcaggagaaggtgatatgtcatcaataaacaatactttgagtaaccatcaactgactcatctacagtcgctgttaaacaacaatcagatgtttcctccaaatcagcaacagcagcaacttctccaggggtaccagaatctccaggcgttccaaggacagtccacaattccttgcccagctaacaataaccccatggcttgtctgtttcagaactttcaggtgagaatgcaggaagatgcagctctcctaaacaaaagaataagcactcagcctgggctcacagcacttcctgagaatccaaacactacacttccaccttttcaagatacaccttgtgagttgcaaccgaggattgacccatctcttggtcaacaggtgaaggatggcctcgttgtgggtggcccaggtgatgcttccgtagatgccatttacaaagcagttgtcgatgcagccagcaaaggaatgcaggttgtcatcaccactgcagtcaacagtacaactcagatcagccccattccagctctgagtgccatgagtgccttcactgcctcaattggtgacccattaaatctctccagtgctgtcagtgcggtcattcatggacggaacatgggaggtgttgatcatgatggtaggctgaggaattcaagaggggctcggctgcccaagaatctagaccatgggaaaaatgtgaacgaaggagatgggtttgaatatttcaagtcagcaagttgccacacatccaaaaaacagtgggacggggagcaaagccccagaggggagcgaaacaggtggaagtacgaggaatttttagatcatccaggccatatccacagtagtccttgtcatgaaaggcccaacaatgtctctacactgccatttctgcctggggaacagcacccaatactgttaccaccaagaaactgtccaggggataaaattctagaggaaaatttcaggtataataactacaaaagaactatgatgagttttaaggagagactagagaacactgtggaaagatgtgcacacataaatgggaatagacctcgacagagtcggggatttggagagctgctaagcactgcaaagcaagacctggtcctagaggagcagtctccaagttcctcaaatagtttggaaaattctctggtcaaagactacatccattacaatggagactttaatgccaaaagcgttaatgggtgtgtgcctagcccttcagatgctaaaagcattagtagtgaagatgacctaaggaacccagactccccctcttcaaatgaattgatacattatagaccaaggacgttcaatgttggcgacttggtctggggccaaatcaaaggactgacttcctggcctggaaaattagtaagagaagacgacgttcacaattcatgtcaacaaagccccgaggaagggaaggtggagcccgagaagttgaagacactaacagaaggtttggaagcctacagccgtgtccggaaaaggaacagaaaaagtggaaagctaaataaccatttagaagctgctattcatgaggccatgagtgaactggacaaaatgtctgggactgtacaccaaatcccacagggtgacagacaaatgagaccccccaaacccaagaggaggaagatctccagataacagagactactccactaatgcgcagtgtttattaaaggaacatgcacagatgtatctgtatataggtattgatatagccacagttatatcaatatttagactatggcagatagctaccaccaccacagggtgctaaaagaaacagtgatacaaaatttttttgatcaggaaggataatgaatgctggaaaagccaatcaaagtctctgtgtgatgagagtgatcaatggtcaagagattactgagaaactctttttctataatactaaattgtgattataagaaatagtccaaatgtttctgaagaattttcaatgttgtatatagaaaatacagaatttcatggtgatatcagaaatgtaaatattgtacagtattgtcatgtacaagcgtacctaatgcacactttatcttttattgtacaaagaaatagtgtacaaaattctttggtttctatggagtacacctaccagagactaccagtgtaaagtgataaataaaaatacaacctaaatgcttttctatgataatgtaaaagatgctgtttttgtatttaacagcagagaaaaggcatgatgatgtaatatctgaattatgacatacactgcacaccactgagtgtccatttatattgtctgtttggaatgaaccttgcctggaagcactggactcaatttcgggtgtctaggaaattgcaactttgcagatttctaaagggatgagggctcacaggtctaaattaagaattcagaaactgcaaccatttgttgcatattttttttacctaagttttaaaatagaataggttttataaaaaaaaatcttagatggaatattttactcagccatttctgtagttaacatttgatagccacctgttgaagcagatagcttatactgactgcaccaccgctggtgctcagaattgagggtttttttgcaaatgatatctgacaaggtaaaactttctatttccgtacatggaggcaaaaaccccactttgcaaccattatcagaggtaagattgataataattcatttttttgtagtggcaaatataaatatgaatcatcaaagcaagtttcatatccattcatcagtattacttaacccagaagttaaggtggcttacggaattattagcaatggtaatttttttatcagtattgtgtaacatatcagatttattttatttaaagaattatttataccattaacagattcttatatatattaatgtggcaaaaatgtgcaggttaaatctattaaccaaattatttatattatattaagtaagaaaaaatgtgaaacaaatgtagagagaaaatactacattacaagtatacaaacctaaaactgtgagccattgtaaagtacaaggtaattaataagaaatgtagcacaacataattttccgtcttcttctcacaatttttgtggtggtggtattaccctatcttccaggcagttaagcaaagtttaggcttccagcctgacttcagttgatggattgtcaaaagaagggatctattatccctttattcttggaaccaccagtccctgccccaaacccttaaacccctagagagcactgcctcgtcctctagcctggggctcacacaacagtctgccactcaggctgctaggagattctccaatagcaggctcagcacctcaaactgcccaccacctctcctactgctcctctcccacccaccacccaaactcctcagtcctgtcatgtagcagagttccagtaactcaggaaaatggagaccaaggtcattccttaagttggtttcttggggccacagcacagagcatgccacctgggctcacttttgatagcaacagctcttagttattcccctaggtctcctgtgtctctctgtccctctgttcctactttcaacctacccccaagcctgatggaatgcaactggctaccctgggcttcatgacctcaaagtaggaacccttcgttctgggggtaggttcattttgtctctcttgtaatggtgggattgcctgcccagttccttcatgcagtcacatgaagtaatcttttgtgtagtttagttgacacatgtttataagttaaaagttgatgtggctagtatgtttaaaccattaatgtccattttttttgcaccaacctgtttttctactgttttttcctacacatttttgtttattcacagacagacagacatgtgtgtttgtatgctgggtgtgtctgtatgtgtgtatgtgttgatatgtaaattttttagcctttgcttttctgtcttcaggctgagtttgtgttgaccaagccttctttttggtattttgagctaattcagtttgtgcttccctcccattgtatactttacataagtagaccatgtaaagtatgtttgtgcccatgatttcactggttgctatggctttgatatgggtgctaggtgtagtagtttcagtccacgtgggtttttttcatctctcttagagttatatggttttgtgtaagcagttaatgtaaatattgttagcattacaggtcatacagtgctgtaacatttttttaaatgttgcacctactttacaattaaaaaattggtcactcgcacttcaattttgcccatagagccatttctttgtctttgtattgaagccaattcatttttttaaatgaaggctaggccttctatgttaccaaaatttttattccctaaaataaactttttaagaaacaaatccaagaatggaaacagatgaaaaattttttcttctttaaagaacataatagttcctgctggaaaaggaaatctaattttattttgtgtcccttaacagtcctaggaagcacaaggagaataaactaaacctctaagaaggttttaaaaattatttcaaatgagtgaaaattaactgagcagcttttgtgtgatttgtcttgtttgtagcattaaaagcaaaccagggtttttatttatttaaaggaacatttttggcttgtacttttcagtgccattatgaatgaaaatgttttaagaacattcatcccttgtgatatcatgggccacttttagtcttttatttggaccctgactttgagtttttgctatgcctgttttttaagtaaacacagccttcttatttgaacgtaacactgcagaattgcaggaagagaaaagggcagttagttatttcactttctgtaagttttaggaagattcttatatcctacgaggtgactcatgtttcattttagaccatgatagcacattgttgttaactttggtaatcttccatgcagtttgcagtgttcccttgcaagtcacaagcatatatgcattaagattttaaaatctaagatgcttaagatgttggtggcattgctctttctgaaaagaaagacaaaatactagaccttgctgaaaattggatatcttatttactttgcccatttatgcccgaatggtgtaatgcaagactcaagacttttcaatgtagtatatcaaatgagttgtgcattgattcatttgggggacatgaacaaaaattatcaaccagccagaactgtaatatttaattagttcatctttttctttcattcactctatcacatttgcattagccaaagagataagaacattagtaattcatatgtgtaaacaacccagaagtgaatattaaatcagtgagccaaaaagcaataaacaactcgagcatgggaaatcctgctaacagtggggagtctgatatagaaaaaatatataaaaagcattatcttcaaatatgaaagattaatttgtatctactgtaaatatgtattaccagccttatctgcatttatacacactgtgtgtgtacctcagtgaccttttataaaccggaaaaatggttgatttaataatttgttatgtaaatacaaagttgtctataaattggaaaatttgatgccagatggcttcataatatacaaatgtgttttgtaacatcatgcctttatggattaagtataaatacactggattgtctatgta

SEQ ID NO: 153335 - DNA, 4343 bp, Homo sapiens
  Payload ID: 10164
  Gene Symbol: MBD5
  Gene Name: methyl-CpG binding domain protein 5
  ENST ID: ENST00000416015
  CDS Start-End: 1-3194
ccaattctagtcctattcacctgaataggactcctctttctccaccttcagtaatgctacatggttctcctgtacagtcatcctgtgcaatggctggaaggactaatatacctctttccccaaccttgactacaaagagtccagtaatgaaaaaaccaatgtgtaatttttcaactaatatggaaataccacgagcaatgttccaccacaaaccaccccaaggcccacctccccctcctccaccttcttgtgctcttcagaaaaagccattaacatctgagaaagatccacttggcattcttgaccctattcctagtaaaccagtgaatcagaaccctgttatcattaatccaaccagtttccattcaaatgtccactctcaggtacctatgatgaatgtaagcatgcctcctgctgttgttcctttgccaagtaatctcccattgccaactgtaaaacctggtcacatgaatcatgggagtcatgtacaaagagttcagcattcagcttcaacctccctgtccccttctccagtgacatcccccgtgcacatgatggggactggaattggaaggattgaggcatcgccccaaagatcacgctcatcttccacatcatcagatcatggaaatttcatgatgccacctgtaggaccccaggccacttctagtggtattaaggttccacccaggtcaccaaggtcaacaatagggtccccaaggccatcaatgccatcaagcccttctaccaagtccgatggacatcatcagtacaaggatatccctaacccattaattgctggaataagtaatgtactaaataccccaagcagtgcagcttttcctactgcatctgccggaagtagttctgtaaagagtcagcctggtttgctgggaatgcctttaaatcagatcttgaaccagcacaatgctgcctcctttccagcaagtagtttactctcagcagcagccaaagcacagctagcaaatcaaaacaaacttgctggtaacaacagtagcagcagtagcaattctggagctgttgccggcagtggcaacactgaaggacatagcactttaaacaccatgttccctcctactgccaacatgcttctcccaacaggtgaagggcaaagtggtcgagcagcactaagagataagctgatgtctcagcaaaaagacgcattgcggaaaagaaaacaaccacctacgacagtgttgagtttgctcagacagtctcaaatggatagttctgcagttcctaaacctggacctgacttgctaaggaagcagggtcagggttcatttcccatcagttcaatgtctcagttactacagtctatgagttgtcaaagctctcacttgagtagcaatagtaccccgggttgtggggcctcaaatactgctttgccttgctctgctaaccagctgcattttacagatcccagtatgaactctagtgttcttcagaacatacctttaagaggggaagccgtgcactgccacaatgcaaacactaactttgttcacagtaacagtccagtccccaaccaccatcttgcaggtttaataaatcagattcaggctagcgggaactgtgggatgctcagtcagtcgggcatggctttaggaaattccttacatcccaatccacctcagtcaagaatttcaacgtcctccactccagtgataccaaacagcattgttagcagctataatcaaacaagttctgaagcaggcggttcaggaccatcatcctccatagccatagcgggcaccaaccaccctgccatcacaaagacaacatctgttcttcaagatggcgtcatagtcaccactgcagctggaaacccactgcagagtcagctacccattgggagtgattttccttttgttggccaggagcacgcacttcattttccatccaacagcacttcaaacaaccatcttccacaccccttgaaccccagcctcctcagttctctacctatctctttgccagtgaatcaacagcatctcctaaaccagaatctattaaatatcctccagccttcagcaggagaaggcaagtctgagatcaacctccaccctttaggttttctcaacccgaatgtaaacgctgctttagcttttctctccagtgacatggatgggcaggtattgcagcctgttcactttcagctcttagcagccttgcttcagaaccaagcccaagcagctgccatgcttcccctgccatctttcaatctgaccatctcagatcttttgcaacagcaaaatacccctttaccctcattaacacagatgacagccccaccagaccatttgccaagcaatcagtcagacaacagccgagctgagacccttttaaccagccccctggggaaccctttaccaagctttgcaggcagtgacactacttttaaccccctgttcctcccagctgtcaatggggcctcaggattaatgaccttgaatccccagctgttgggaggtgtcctgaactcggcatcggccaacaccgctaatcatccagaggtttccatagcaacctcctcccaggcaaccactaccacaaccactacatcatcagcagtggcagcactgactgtctcaacacttggtgggacagcagtggtgtcaatggcagaaacattgctgaatatatctaataatgctgggaatacacctggtccagctaaactcaacagtaactctgtggtgccacagctacttaaccctctactggggacaggtctacttggtgatatgtcatcaataaacaatactttgagtaaccatcaactgactcatctacagtcgctgttaaacaacaatcagatgtttcctccaaatcagcaacagcagcaacttctccaggggtaccagaatctccaggcgttccaaggacagtccacaattccttgcccagctaacaataaccccatggcttgtctgtttcagaactttcaggtggagcccgagaagttgaagacactaacagaaggtttggaagcctacagccgtgtccggaaaaggaacagaaaaagtggaaagctaaataaccatttagaagctgctattcatgaggccatgagtgaactggacaaaatgtctgggactgtacaccaaatcccacagggtgacagacaaatgagaccccccaaacccaagaggaggaagatctccagataacagagactactccactaatgcgcagtgtttattaaaggaacatgcacagatgtatctgtatataggtattgatatagccacagttatatcaatatttagactatggcagatagctaccaccaccacagggtgctaaaagaaacagtgatacaaaatttttttgatcaggaaggataatgaatgctggaaaagccaatcaaagtctctgtgtgatgagagtgatcaatggtcaagagattactgagaaactctttttctataatactaaattgtgattataagaaatagtccaaatgtttctgaagaattttcaatgttgtatatagaaaatacagaatttcatggtgatatcagaaatgtaaatattgtacagtattgtcatgtacaagcgtacctaatgcacactttatcttttattgtacaaagaaatagtgtacaaaattctttggtttctatggagtacacctaccagagactaccagtgtaaagtgataaataaaaatacaacctaaatgcttttctatgataatgtaaaagatgctgtttttgtatttaacagcagagaaaaggcatgatgatgtaatatctgaattatgacatacactgcacaccactgagtgtccatttatattgtctgtttggaatgaaccttgcctggaagcactggactcaatttcgggtgtctaggaaattgcaactttgcagatttctaaagggatgagggctcacaggtctaaattaagaattcagaaactgcaaccatttgttgcatattttttttacctaagttttaaaatagaataggttttataaaaaaaaatcttagatggaatattttactcagccatttctgtagttaacatttgatagccacctgttgaagcagatagcttatactgactgcaccaccgctggtgctcagaattgagggtttttttgcaaatgatatctgacaaggtaaaactttctatttccgtacatggaggcaaaaaccccactttgcaaccattatcagaggtaagattgataataattcatttttttgtagtggcaaatataaatatgaatcatcaaagcaagtttcatatccattcatcagtattacttaacccagaagttaaggtggcttacggaattattagcaatggt

SEQ ID NO: 153336 - DNA, 663 bp, Homo sapiens
  Payload ID: 10164
  Gene Symbol: MBD5
  Gene Name: methyl-CpG binding domain protein 5
  ENST ID: ENST00000630352
  CDS Start-End: 1-233
actccccctcttcaaatgaattgatacattatagaccaaggacgttcaatgttggcgacttggtctggggccaaatcaaaggactgacttcctggcctggaaaattagtaagagaagacgacgttcacaattcatgtcaacaaagccccgaggaagggaaggtacaccaaatcccacagggtgacagacaaatgagaccccccaaacccaagaggaggaagatctccagataacagagactactccactaatgcgcagtgtttattaaaggaacatgcacagatgtatctgtatataggtattgatatagccacagttatatcaatatttagactatggcagatagctaccaccaccacagggtgctaaaagaaacagtgatacaaaatttttttgatcaggaaggataatgaatgctggaaaagccaatcaaagtctctgtgtgatgagagtgatcaatggtcaagagattactgagaaactctttttctataatactaaattgtgattataagaaatagtccaaatgtttctgaagaattttcaatgttgtatatagaaaatacagaatttcatggtgatatcagaaatgtaaatattgtacagtattgtcatgtacaagcgtacctaatgcacactttatcttttattgtacaaagaaat

SEQ ID NO: 153337 - DNA, 914 bp, Homo sapiens
  Payload ID: 10164
  Gene Symbol: MBD5
  Gene Name: methyl-CpG binding domain protein 5
  ENST ID: ENST00000628572
  CDS Start-End: 1-342
ccaagttcctcaaatagtttggaaaattctctggtcaaagactacatccattacaatggagactttaatgccaaaagcgttaatgggtgtgtgcctagcccttcagatgctaaaagcattagtagtgaagatgacctaaggaacccagactccccctcttcaaatgaattgatacattatagaccaaggacgttcaatgttggcgacttggtctggggccaaatcaaaggactgacttcctggcctggaaaattagtaagagaagacgacgttcacaattcatgtcaacaaagccccgaggaagggaaggtataccaatctttatccattgtcaaatactaacctttgttcagatatcaattattgctttttgttatcatcactttggattctttggatttgaaattaggattcttcatgactcattgaggtctcacaagcttctggagcataaaatgaagaggggatggttatagtcaacaaaatgtcgtatcaacaaggggtggagcccgagaagttgaagacactaacagaaggtttggaagcctacagccgtgtccggaaaaggaacagaaaaagtggaaagctaaataaccatttagaagctgctattcatgaggccatgagtgaactggacaaaatgtctgggactgtacaccaaatcccacagggtgacagacaaatgagaccccccaaacccaagaggaggaagatctccagataacagagactactccactaatgcgcagtgtttattaaaggaacatgcacagatgtatctgtatataggtattgatatagccacagttatatcaatatttagactatggcagatagctaccaccaccacagggtgctaaaagaaacagtgatacaaaatttttttgatcaggaaggataatgaatgctggaaa

SEQ ID NO: 153338 - DNA, 5610 bp, Homo sapiens
  Payload ID: 10164
  Gene Symbol: MBD5
  Gene Name: methyl-CpG binding domain protein 5
  Uniprot ID: Q9P267
  ENST ID: ENST00000627651
  CDS Start-End: 1099-3654
atgtacattgaagatgtcagtttctacatgtgggaagtagacattgaaggctttatggtttacagacaagatctttagaagataagcactaaaggaccaaggaaataaataccagaaatcaagaagagcacacactattttccttcatcaatccatagaaccctaatgcttctttagttccatcaaacacagaggaatgaccaccatggcagatggcaacagaggatgtcaacaattttttggagagagaagaggtactcccttatagggactcgtaaagacatagagcatctggaaattaactgcctccattacactgctgagtcacacacaacgcttgttatgttttcatcacttctctccagaagaagttggaaacccacatgcctatagaggccaggctgatgggaatgaagcaggaagctattgcagtgaactggagcgccaaatcctttctggaggagcagccactgctccattccagataattgttgcaaggcaggaatgttggcctagtgttaccatattgtccagtttctcaggctacattattggaattttgaagtcatgaaaacatcagatgaaccaacctgcaacaccttggattcagattggaagataaagagaaagtttaaagaatgtggcctataaaggcgggtacctggaaatattaaccgactcacactgtaaaaatgagaccagtttctaaacaatagagattgtcttagtacaacatcaaggttcaagacaaatgttgaactaaaaactttacactccccacccccacttcagacaggtaccagcattggtgaattatgattttccttagtcagaagcactcatttttacccatgtagaccatccttaggaattaaatattggttatttaatgtagattataatgggaagctgatttttttcacaatggcatatttcaaggacttggttccaaactgagctgaagcttcccaatgcgttttgtacagtctgggaaaaactgtgctgcactggcccacttttgaaggccatcatgctctgtaatataaggatatcatcttattgctgatatctttggagagtccctagcagacacagaaaatgaatggaggcaaagagtgtgacggaggggacaaggaaggaggtcttccagctatacaagttcctgtgggttggcagcgtcgtgtggatcaaaatggagtgctttatgtcagtcccagtgggtctttgttatcttgcttggagcaggttaaaacatacctgcttactgatggaacatgcaagtgtggcttggaatgtcctcttattcttcccaaggtatttaattttgatcctggagctgctgtgaaacagagaaccgcagaagatgttaaggcagatgaagatgtcacaaagctatgcatacataaaagaaaaattattgcagtggccacacttcataaaagcatggaagccccacatccttctctggtgctcaccagtcccggaggaggaacaaatgcaactccagtagtaccttctcgggcagcaactccaagatcagtaagaaataagtctcatgaaggaattacaaattctgtaatgcctgaatgtaagaatcctttcaagttaatgattggatcatcaaatgccatgggaaggctatatgtacaagaactgcctggaagccaacaacaagaactccaccctgtctacccccgacagagattgggcagcagtgaacatggacagaaatctccattccgtggcagccatggaggcctgcccagcccagcgtcatcaggttcccagatatatggagatggttcaatctctccaaggactgacccacttggaagtcctgatgttttcacaagaagtaatcctggttttcatggagctcccaattctagtcctattcacctgaataggactcctctttctccaccttcagtaatgctacatggttctcctgtacagtcatcctgtgcaatggctggaaggactaatatacctctttccccaaccttgactacaaagagtccagtaatgaaaaaaccaatgtgtaatttttcaactaatatggaaataccacgagcaatgttccaccacaaaccaccccaaggcccacctccccctcctccaccttcttgtgctcttcagaaaaagccattaacatctgagaaagatccacttggcattcttgaccctattcctagtaaaccagtgaatcagaaccctgttatcattaatccaaccagtttccattcaaatgtccactctcaggtacctatgatgaatgtaagcatgcctcctgctgttgttcctttgccaagtaatctcccattgccaactgtaaaacctggtcacatgaatcatgggagtcatgtacaaagagttcagcattcagcttcaacctccctgtccccttctccagtgacatcccccgtgcacatgatggggactggaattggaaggattgaggcatcgccccaaagatcacgctcatcttccacatcatcagatcatggaaatttcatgatgccacctgtaggaccccaggccacttctagtggtattaaggttccacccaggtcaccaaggtcaacaatagggtccccaaggccatcaatgccatcaagcccttctaccaagtccgatggacatcatcagtacaaggatatccctaacccattaattgctggaataagtaatgtactaaataccccaagcagtgcagcttttcctactgcatctgccggaagtagttctgtaaagagtcagcctggtttgctgggaatgcctttaaatcagatcttgaaccagcacaatgctgcctcctttccagcaagtagtttactctcagcagcagccaaagcacagctagcaaatcaaaacaaacttgctggtaacaacagtagcagcagtagcaattctggagctgttgccggcagtggcaacactgaaggacatagcactttaaacaccatgttccctcctactgccaacatgcttctcccaacaggtgaagggcaaagtggtcgagcagcactaagagataagctgatgtctcagcaaaaagacgcattgcggaaaagaaaacaaccacctacgacagtgttgagtttgctcagacagtctcaaatggatagttctgcagttcctaaacctggacctgacttgctaaggaagcagggtcagggttcatttcccatcagttcaatgtctcagttactacagtctatgagttgtcaaagctctcacttgagtagcaatagtaccccgggttgtggggcctcaaatactgctttgccttgctctgctaaccagctgcattttacagatcccagtatgaactctagtgttcttcagaacatacctttaagaggggaagccgtgcactgccacaatgcaaacactaactttgttcacagtaacagtccagtccccaaccaccatcttgcaggtttaataaatcagattcaggctagcgggaactgtgggatgctcagtcagtcgggcatggctttaggaaattccttacatcccaatccacctcagtcaagaatttcaacgtcctccactccagtgataccaaacagcattgttagcagctataatcaaacaagttctgaagcaggtatggttttattagaaaaaagtacccaaaggtactaaacttttctacttttttaaaaaatttgtaccaaaatatttattatgataagaaatgatcctttccccattgtgaaattctcttcatttctttagtatttataattttatttacagaatgctagggatttgtctattgggaagattaacagctaagaggatttcatgtgtttccattatttgttgtcaatctgtgtcattttgaatattgttcgactttcacttggttttataaccattggactccaaactgcaaaataagccatacgaggcagggtttcctggtttgtgagacatgtccttggtctatgccaatataaaagccatctccctagcttttgtttgtattcaggtaaatgaagtttatcttggaaaaatccaaaaaggcaaaaataaatggattttttttcttgctgctgaacagaagtaggtgaatggataggaaaaggtaactagaagttgtacgaagtagaaggctgtcttctaatgtgttttcttatcctagtttgctatccttattatttgtttgagaaaactcaaaaatggatattggctactcccttttaaaaaaaaagctaataatttaagctttctaataaaaaaaaggcttgaaaacctgatttccagaatttttaatcttgaaattgttttttgagtttcttgtagaactaaaccatttttatcattgacattaaggttttgaacccaaatctattgtatctcttcagccaccattaaggaaacaaatttatttaaaagtaggcatattagaaaaagacctgtattttgtgcaatagagtcctcagaaattgttataaaaactgtacagaagcacctaagaggtaaatgtgttgaggcatcagaaaatttgactatgaaaacattattcaacactaatgatttatgagaaatgacaaggaggaaataaaagatggttgtaaagacattattgttcactatgaaaacagtgtgctatgaaaaccagattgctactgggaatgagaaaactgctgaggtttttaataataagctagtgtgtaggtataataccgtcatgctggagaagcattctaacccacatgtctttgttgctgatagtaaaagcgttttccttcctagtgttgccatttacacctgccatccttcacatcttgtgttatgtgttatgttttgatgtcactatttaatgaagaactattcaatgatctcttatgttaaatatatatatggtttagaagatatttgaaattattagtgccttcttgatattcttagtttaaagaatctcataaaactttatgttttatgtgtctaacagtatacttatcccatagggggcttccagcttttcactcactcatcatatttctttttagataactcgacacaaatgaaaattttattttatctatttagcagaaaagtcacacaaagttcataactatttaaaagtacaccatatttattgagcataccttaaataattttgatgggacatttttagtctcattgcattatacagttttgatatcccctacctcagtttacttcatttcaggtctgagttcatgtgcaaagtgtatgtatttcattgatgtatttcaattcatctataatggaaaagaccaacatttacttatattcttgtttcttctgatggtcaagtttagacttatttaatactgttttggtcatttattttttttgtttcatgtatctttgtaatacatctgacctgtactgttactgctgggggtgtcaaagcatataggttaaaaatttattagtgtcagaaaagtgtgagcatataaatagctaaaaaggataaggatacatgtctagaaatgatatgaatatgaccaactagtgtaaactaacaggaagtatgtgcttaataaaaatctaagtagaatttttaaagtattaaacctaataaaattaaatactaattaacgtgca

SEQ ID NO: 153339 - DNA, 4130 bp, Homo sapiens
  Payload ID: 10164
  Gene Symbol: MBD5
  Gene Name: methyl-CpG binding domain protein 5
  ENST ID: ENST00000629878
  CDS Start-End: 313-3573
cttcagacaggtaccagcattggtgaattatgattttccttagtcagaagcactcatttttacccatgtagaccatccttaggaattaaatattggttatttaatgtagattataatgggaagctgatttttttcacaatggcatatttcaaggacttggttccaaactgagctgaagcttcccaatgcgttttgtacagtctgggaaaaactgtgctgcactggcccacttttgaaggccatcatgctctgtaatataaggatatcatcttattgctgatatctttggagagtccctagcagacacagaaaatgaatggaggcaaagagtgtgacggaggggacaaggaaggaggtcttccagctatacaagttcctgtgggttggcagcgtcgtgtggatcaaaatggagtgctttatgtcagtcccagtgggtctttgttatcttgcttggagcaggttaaaacatacctgcttactgatggaacatgcaagtgtggcttggaatgtcctcttattcttcccaaggtatttaattttgatcctggagctgctgtgaaacagagaaccgcagaagatgttaaggcagatgaagatgtcacaaagctatgcatacataaaagaaaaattattgcagtggccacacttcataaaagcatggaagccccacatccttctctggtgctcaccagtcccggaggaggaacaaatgcaactccagtagtaccttctcgggcagcaactccaagatcagtaagaaataagtctcatgaaggaattacaaattctgtaatgcctgaatgtaagaatcctttcaagttaatgattggatcatcaaatgccatgggaaggctatatgtacaagaactgcctggaagccaacaacaagaactccaccctgtctacccccgacagagattgggcagcagtgaacatggacagaaatctccattccgtggcagccatggaggcctgcccagcccagcgtcatcaggttcccagatatatggagatggttcaatctctccaaggactgacccacttggaagtcctgatgttttcacaagaagtaatcctggttttcatggagctcccaattctagtcctattcacctgaataggactcctctttctccaccttcagtaatgctacatggttctcctgtacagtcatcctgtgcaatggctggaaggactaatatacctctttccccaaccttgactacaaagagtccagtaatgaaaaaaccaatgtgtaatttttcaactaatatggaaataccacgagcaatgttccaccacaaaccaccccaaggcccacctccccctcctccaccttcttgtgctcttcagaaaaagccattaacatctgagaaagatccacttggcattcttgaccctattcctagtaaaccagtgaatcagaaccctgttatcattaatccaaccagtttccattcaaatgtccactctcaggtacctatgatgaatgtaagcatgcctcctgctgttgttcctttgccaagtaatctcccattgccaactgtaaaacctggtcacatgaatcatgggagtcatgtacaaagagttcagcattcagcttcaacctccctgtccccttctccagtgacatcccccgtgcacatgatggggactggaattggaaggattgaggcatcgccccaaagatcacgctcatcttccacatcatcagatcatggaaatttcatgatgccacctgtaggaccccaggccacttctagtggtattaaggttccacccaggtcaccaaggtcaacaatagggtccccaaggccatcaatgccatcaagcccttctaccaagtccgatggacatcatcagtacaaggatatccctaacccattaattgctggaataagtaatgtactaaataccccaagcagtgcagcttttcctactgcatctgccggaagtagttctgtaaagagtcagcctggtttgctgggaatgcctttaaatcagatcttgaaccagcacaatgctgcctcctttccagcaagtagtttactctcagcagcagccaaagcacagctagcaaatcaaaacaaacttgctggtaacaacagtagcagcagtagcaattctggagctgttgccggcagtggcaacactgaaggacatagcactttaaacaccatgttccctcctactgccaacatgcttctcccaacaggtgaagggcaaagtggtcgagcagcactaagagataagctgatgtctcagcaaaaagacgcattgcggaaaagaaaacaaccacctacgacagtgttgagtttgctcagacagtctcaaatggatagttctgcagttcctaaacctggacctgacttgctaaggaagcagggtcagggttcatttcccatcagttcaatgtctcagttactacagtctatgagttgtcaaagctctcacttgagtagcaatagtaccccgggttgtggggcctcaaatactgctttgccttgctctgctaaccagctgcattttacagatcccagtatgaactctagtgttcttcagaacatacctttaagaggggaagccgtgcactgccacaatgcaaacactaactttgttcacagtaacagtccagtccccaaccaccatcttgcaggtttaataaatcagattcaggctagcgggaactgtgggatgctcagtcagtcgggcatggctttaggaaattccttacatcccaatccacctcagtcaagaatttcaacgtcctccactccagtgataccaaacagcattgttagcagctataatcaaacaagttctgaagcaggcggttcaggaccatcatcctccatagccatagcgggcaccaaccaccctgccatcacaaagacaacatctgttcttcaagatggcgtcatagtcaccactgcagctggaaacccactgcagagtcagctacccattgggagtgattttccttttgttggccaggagcacgcacttcattttccatccaacagcacttcaaacaaccatcttccacaccccttgaaccccagcctcctcagttctctacctatctctttgccagtgaatcaacagcatctcctaaaccagaatctattaaatatcctccagccttcagcaggagaaggtgatatgtcatcaataaacaatactttgagtaaccatcaactgactcatctacagtcgctgttaaacaacaatcagatgtttcctccaaatcagcaacagcagcaacttctccaggggtaccagaatctccaggcgttccaaggacagtccacaattccttgcccagctaacaataaccccatggcttgtctgtttcagaactttcaggtgagaatgcaggaagatgcagctctcctaaacaaaagaataagcactcagcctgggctcacagcacttcctgagaatccaaacactacacttccaccttttcaagatacaccttgtggagcccgagaagttgaagacactaacagaaggtttggaagcctacagccgtgtccggaaaaggaacagaaaaagtggaaagctaaataaccatttagaagctgctattcatgaggccatgagtgaactggacaaaatgtctgggactgtacaccaaatcccacagggtgacagacaaatgagaccccccaaacccaagaggaggaagatctccagataacagagactactccactaatgcgcagtgtttattaaaggaacatgcacagatgtatctgtatataggtattgatatagccacagttatatcaatatttagactatggcagatagctaccaccaccacagggtgctaaaagaaacagtgatacaaaatttttttgatcaggaaggataatgaatgctggaaaagccaatcaaagtctctgtgtgatgagagtgatcaatggtcaagagattactgagaaactctttttctataatactaaattgtgattataagaaatagtccaaatgtttctgaagaattttcaatgttgtatatagaaaatacagaatttcatggtgatatcagaaatgtaaatattgtacagtattgtcatgtacaagcgtacctaatgcacactttatcttttattgtacaaaga

SEQ ID NO: 153340 - DNA, 4282 bp, Homo sapiens
  Payload ID: 10165
  Gene Symbol: MBD6
  Gene Name: methyl-CpG binding domain protein 6
  Uniprot ID: Q96DN6
  ENST ID: ENST00000355673
  CDS Start-End: 357-3368
gcggctgcggcagcgacggcggcggcggcagcggcagcagcctgcgcagtgccttctgggaacggaatccccagggctgcccctggcccccatggcgcatgcgcgggaggccgctcggtgatccgcggcggcggcagcggcgcttcctgctaggaccggccggggccgtaccggaggctcgggctccaccgaccctcctcccaccccctcccactcaccctctgggccgcgactgcgcagggcggggccggccgaaccatgggccgcggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacagtgggtgggggcactactccccactcagagcacaaatgcaactccttcccctacaatcccatcctgagccattgcagggggcagggaagttcacccccccccaccacccccccgcccccccgaagccatgtcactgaaaaggcctgggggggatggtatatggccctttccccaccaggcgctaaggggaacacccccttccccaggtcttttatttgtttaagttatttttgcacaaatgactcttttatatttaattcgatttcattgcctcccttcttaaagccaacaggctcagtttacaaacctgtgagctactgttggctgctgccctccttcccagtgaaaggtacaaagcaataagcatcatgcatcctccccttacccctccaacacccctctgcctctggctcaggttgctcaaagcacagatcctctcttaccccgtccccaggtttgaaacacatagcctcatttcaaggtgtagccaggttcccccgactttcctctgggatataaaaaagggggtaagggggcaaagagagccctctgggcctctcctcccatacacactacactgccccttctccccccatcaaaacgctcagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctg

SEQ ID NO: 153341 - DNA, 544 bp, Homo sapiens
  Payload ID: 10165
  Gene Symbol: MBD6
  Gene Name: methyl-CpG binding domain protein 6
  ENST ID: ENST00000549623
  CDS Start-End: 346-544
atgcgcgggaggccgctcggtgatccgcggcggcggcagcggcgcttcctgctaggaccggccggggccgtaccggaggctcgggctccaccgaccctcctcccaccccctcccactcaccctctgggccgcgactgcgcagggcggggccggccgaaccatgggccgcgtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggct

SEQ ID NO: 153342 - DNA, 530 bp, Homo sapiens
  Payload ID: 10165
  Gene Symbol: MBD6
  Gene Name: methyl-CpG binding domain protein 6
  ENST ID: ENST00000552659
  CDS Start-End: 1-530
gagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctgggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggc

SEQ ID NO: 153343 - DNA, 509 bp, Homo sapiens
  Payload ID: 10165
  Gene Symbol: MBD6
  Gene Name: methyl-CpG binding domain protein 6
  ENST ID: ENST00000552255
  CDS Start-End: 374-509
accctctgccccctccgcgtcctctcggcccctttccccggccccatccccactcccccgccctcacctgcccccgccgcttctccctctcactgccagacttctgccttcctcaccgccctcccctcagtgcttcgcccaccctccgcccgccctctccccaagttccttcctacttcgtgcgccttcccctcctcctcaagctgagggaagcagtctgggtgacagggcgccttgttgtgagagggaaagtttggaagccgccagtgtggggtgggagcaatggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtctt

SEQ ID NO: 153344 - DNA, 387 bp, Homo sapiens
  Payload ID: 10165
  Gene Symbol: MBD6
  Gene Name: methyl-CpG binding domain protein 6
  ENST ID: ENST00000547844
  CDS Start-End: 1-83
cagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacaagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactc

SEQ ID NO: 153345 - DNA, 568 bp, Homo sapiens
  Payload ID: 10165
  Gene Symbol: MBD6
  Gene Name: methyl-CpG binding domain protein 6
  ENST ID: ENST00000548887
  CDS Start-End: 123-568
aagtggctttgggtcacgaggcttcacggaggaggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctg

SEQ ID NO: 153346 - DNA, 607 bp, Homo sapiens
  Payload ID: 10165
  Gene Symbol: MBD6
  Gene Name: methyl-CpG binding domain protein 6
  ENST ID: ENST00000546632
  CDS Start-End: 448-607
gcatgcgcgggaggccgctcggtgatccgcggcggcggcagcggcgcttcctgctaggaccggccggggccgtaccggaggctcgggctccaccgaccctcctcccaccccctcccactcaccctctgggccgcgactgcgcagggcggggccggccgaaccatgggccgcggtgtgggctaagctggtggccccggctttagactggaccccacaatgtttgcagagatgttcaggtagctgtggtgatacggcagaggactcctcagtctccctcccagctgaggggttccccttgctcctctggggcttcccctgagttttcttgggtctccccacaacctttgccttcctggagtcctctctcaggtacttcgctcagtttaatcctcctagtgcctacatggatgtctgtgttatcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacc

SEQ ID NO: 153347 - DNA, 533 bp, Homo sapiens
  Payload ID: 10165
  Gene Symbol: MBD6
  Gene Name: methyl-CpG binding domain protein 6
  ENST ID: ENST00000549042
  CDS Start-End: 89-232
gtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcaggaggatctgtaacttaagcactgtgctttaggagtattgcctgattcgctgccagctaaccccatgtcctctgaccctgtcctctcgcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggaga

SEQ ID NO: 153348 - DNA, 596 bp, Homo sapiens
  Payload ID: 10165
  Gene Symbol: MBD6
  Gene Name: methyl-CpG binding domain protein 6
  ENST ID: ENST00000546805
  CDS Start-End: 377-596
acctattttcccccacggtactcctatggctttctccaagaccctctcttgctgtaccagacagcaagtcctgtgactccctgtgtgaggagcgcggcacaggcctgcctcctaggtgttcgggtcgagatttacagcggagtctcatcccgggacgtgtgagtgcacttcagcgcaggactgccctggactggggagaccggagccgcgattttagactcaactccccatcacttgccaagggatcttaccgtccttgtttgtaaattaaagataaaagttgtgaaggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttt

SEQ ID NO: 153349 - DNA, 1884 bp, Homo sapiens
  Payload ID: 10165
  Gene Symbol: MBD6
  Gene Name: methyl-CpG binding domain protein 6
  ENST ID: ENST00000547545
  CDS Start-End: 1-1515
gggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacagtggccaacaggctcagtttacaaacctgtgagctactgttggctgctgccctccttcccagtgaaagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaa

SEQ ID NO: 153350 - DNA, 570 bp, Homo sapiens
  Payload ID: 10165
  Gene Symbol: MBD6
  Gene Name: methyl-CpG binding domain protein 6
  ENST ID: ENST00000552163
  CDS Start-End: 1-570
tcttctctctggccagttggggctgcagctcctccctggggggggagctcctccacccctctcagaggcttctagtcccctagcctgcctgctacagagtctccagcagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaa

SEQ ID NO: 153351 - DNA, 532 bp, Homo sapiens
  Payload ID: 10165
  Gene Symbol: MBD6
  Gene Name: methyl-CpG binding domain protein 6
  ENST ID: ENST00000551351
  CDS Start-End: 374-532
agtcggtcgtgagcctctttgccgcttgtctcccccagaagctgctgttccgcccacctagctttacccgccgttttacccccactataagggactcccatatttcttggcccctcccagctaatgggcacataggccttttgaacttttctttttaaagttggtatccatccactgggattgtcgacatctcgagtcttcttaaagaggtctcctggccgggctcagtggcttacgcctgtaatcccagcactttgggaggctgaggagagcggatcacttgaggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctac

SEQ ID NO: 153352 - DNA, 2545 bp, Homo sapiens
  Payload ID: 10166
  Gene Symbol: MCCC1
  Gene Name: methylcrotonoyl-CoA carboxylase 1 (alpha)
  Uniprot ID: Q96RQ3
  ENST ID: ENST00000265594
  CDS Start-End: 148-2325
acattcttggatcagcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagccaa

SEQ ID NO: 153353 - DNA, 567 bp, Homo sapiens
  Payload ID: 10166
  Gene Symbol: MCCC1
  Gene Name: methylcrotonoyl-CoA carboxylase 1 (alpha)
  ENST ID: ENST00000466650
  CDS Start-End: 91-234
acgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggcagatgaagcatattccatcggccccgctccctcccagcagagctacctatctatggagaaaatcattcaagtggccaagacctctgctgcacagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaatcataatcatcttttctctcttagggaatgaggattgttagatcagaacaagaatttcaagaacagttagagtcagcacggagagaagctaagaagt

SEQ ID NO: 153354 - DNA, 557 bp, Homo sapiens
  Payload ID: 10166
  Gene Symbol: MCCC1
  Gene Name: methylcrotonoyl-CoA carboxylase 1 (alpha)
  ENST ID: ENST00000490284
  CDS Start-End: 84-254
ttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagaca

SEQ ID NO: 153355 - DNA, 1860 bp, Homo sapiens
  Payload ID: 10166
  Gene Symbol: MCCC1
  Gene Name: methylcrotonoyl-CoA carboxylase 1 (alpha)
  ENST ID: ENST00000495767
  CDS Start-End: 79-264
agtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctc

SEQ ID NO: 153356 - DNA, 2774 bp, Homo sapiens
  Payload ID: 10166
  Gene Symbol: MCCC1
  Gene Name: methylcrotonoyl-CoA carboxylase 1 (alpha)
  ENST ID: ENST00000492597
  CDS Start-End: 704-2554
ggaggcttctgagggtttcctaggggttttgctgggttctttctagcttaatttaaaaaaaaccctacttgagggggctcttcagcaactgcttgctcgagcccactcccactctgtgaccgtcttcaataaatctgtgcccactccgtggtgttgtgttcaactatttgtccaatacgccaagaacctggacatcacatttaggactttttttttttaatttgagatggagttttgctcttgtcactcaggctggagtgcagtggcgtgatctcggctcactgcaacttccgcctcccgggttcaagcgattcttccacctcagcctcccgagtagctgggattacaggcgcccaacaccatgcccagctaatttttgtatttttagtagagatggagtttcaccatgttggccaggctggtctccaactcctgacctcagatgatccacccacctcagcctcccaaagtgctgggattacgggcgtgggccaccgcacctggcagcatttaggaccttctctctggtaacataagtaggggaagagacaacacacacccaaaatggcaagaatccgctggcacggacaggctggacccaggacatgggtgtggaggcaaagaaccatgaagtacacaacagccacaggcagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagccaa

SEQ ID NO: 153357 - DNA, 2227 bp, Homo sapiens
  Payload ID: 10166
  Gene Symbol: MCCC1
  Gene Name: methylcrotonoyl-CoA carboxylase 1 (alpha)
  ENST ID: ENST00000497830
  CDS Start-End: 91-234
acgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggcagatgaagcatattccatcggccccgctccctcccagcagagctacctatctatggagaaaatcattcaagtggccaagacctctgctgcacagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagcc

SEQ ID NO: 153358 - DNA, 581 bp, Homo sapiens
  Payload ID: 10166
  Gene Symbol: MCCC1
  Gene Name: methylcrotonoyl-CoA carboxylase 1 (alpha)
  ENST ID: ENST00000486226
  CDS Start-End: 56-394
tgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatgcaggatgatcttgatttcacagagaaaataaaattgaggttcctgccacagaatctgctgacttagttatgtctgcatccatctttcccatcgaaggcagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagc

SEQ ID NO: 153359 - DNA, 1906 bp, Homo sapiens
  Payload ID: 10166
  Gene Symbol: MCCC1
  Gene Name: methylcrotonoyl-CoA carboxylase 1 (alpha)
  ENST ID: ENST00000476176
  CDS Start-End: 111-1906
gacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactca

SEQ ID NO: 153360 - DNA, 559 bp, Homo sapiens
  Payload ID: 10166
  Gene Symbol: MCCC1
  Gene Name: methylcrotonoyl-CoA carboxylase 1 (alpha)
  ENST ID: ENST00000487634
  CDS Start-End: 79-264
agtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtct

SEQ ID NO: 153361 - DNA, 2874 bp, Homo sapiens
  Payload ID: 10166
  Gene Symbol: MCCC1
  Gene Name: methylcrotonoyl-CoA carboxylase 1 (alpha)
  ENST ID: ENST00000497959
  CDS Start-End: 782-2086
ggtaggaaaaccccaggcactttcggaggggttctgccggcagtcacggcgtcgggaggaagacatccccaccagcccttccctttctccccgcttccgcacatccacgcttcagcgcgcctttggcttctgtttttccatttctgaggactgggcccgccatcctccaggctcccctcgccgtcgctgcagctcgtagccgtttacatcgggctttcgcagcaccccttaggtgggagcgttgttataatccggttccggggaagcccaaagggatcaacgacttcctcaacgaaacacagctagtaagaaatggggccgggatgccctcaaagccatttttcagttcagctgtgccccatcaggtgtccagttcagagaaagactcctggagttccttctcattgttagaagagtgaagttgtcaagaagagcaaatgtaccttccacagagctgggaaattattttgtcaaaaactcttgtacccaagtttgaacaacgctatcagatgactcagtctagctcacctgactccagctctgtttcaaattttgagctctaagctttggtggcaataactctggcagtgaaaaaaccctcaggcttgtagatagctttgcttctttgtcttcttttgcttcatcgttatcatccttcatcattctggaaagattgacagtttagtgttcaagggcacagactctgcagtcaaggctgaggtcttagttagctactcactaggtgtgtgactttgggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatatcaattctctccattttcgtctagcagtggaagaagactgaatatctcgtataccagaaacatgactcttaaagatggtaaaaacagttttcgtctcctcggataatcaaccatttccatactcatgtaatctaggcatactctggagttattacaggtttggttccagaccactacaataaaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcat

SEQ ID NO: 153362 - DNA, 2156 bp, Homo sapiens
  Payload ID: 10166
  Gene Symbol: MCCC1
  Gene Name: methylcrotonoyl-CoA carboxylase 1 (alpha)
  ENST ID: ENST00000539926
  CDS Start-End: 211-1938
agtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggcagatgaagcatattccatcggccccgctccctcccagcagagctacctatctatggagaaaatcattcaagtggccaagacctctgctgcacagcacatccaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagcc

SEQ ID NO: 153363 - DNA, 2410 bp, Homo sapiens
  Payload ID: 10166
  Gene Symbol: MCCC1
  Gene Name: methylcrotonoyl-CoA carboxylase 1 (alpha)
  ENST ID: ENST00000610757
  CDS Start-End: 465-2192
atcagcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacagcacatccaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagcc

SEQ ID NO: 153364 - DNA, 2316 bp, Homo sapiens
  Payload ID: 10166
  Gene Symbol: MCCC1
  Gene Name: methylcrotonoyl-CoA carboxylase 1 (alpha)
  ENST ID: ENST00000629669
  CDS Start-End: 252-1556
atcagcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagcc

SEQ ID NO: 153365 - DNA, 3665 bp, Homo sapiens
  Payload ID: 10167
  Gene Symbol: MCCC2
  Gene Name: methylcrotonoyl-CoA carboxylase 2 (beta)
  Uniprot ID: Q9HCC0
  ENST ID: ENST00000340941
  CDS Start-End: 130-1821
agaatcagagaaaccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttacggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagtggcataaagtgccctcacactgctgtgcagccatcaccaccattcatctccagaatttgttctcagtcccaaactgaaactataccattcaaacaacagcgctccccatttccccctcccccgagcccatgacatctccttattattattttttttttgagacagggtgtttctctgttgcccaggctggagtgcggtggtgtgatctcggctcactgcagcttccacctcccgggttcaagcgattcttgtgcctcagcctcccaagcagctgggactataggcacgcaccaccacacccagctaagttctgtatttttagcagagacgggatttcactaggttgcccaggctggtctcaaactactgacctcaagtgatccacccgcctcggcctcccaaagtgctgggattacaggtgtgagccaccgcgcctgaccacatctccttattcttaaatgtatgtgtttctcatggtttgatttattcttgctgggccatttcagcccctgtcatggcttcactcgccatctaaatgcagatgattactgccttgacggttcttaacccagctctcccctgagctgcaggcctgcatatccagtaggtctactggacatctgtactggttgttgtggaggaacctctggcttgctcattaagtcctactgattttcactatcccctgaatttccccacttatttttgtctttcactatcgcaggccttagaagaggtctacctgcctccagtcttacctagtccagtctaccccctggagttagaatggccatcctgaagtgaaaagtaatgtcagattactcccttcagtgatttcttgtagaagtgccaatccctgaatgccaccaagatcttaatcttcacatctttaatcttatctctttgactcctctttacaccggagaacggctccagctgttctagctctctttcagttctttgaaccttcccaccttagggtctataaggttccctctgcccaaattgttctactctcccttcttcttcaacacatccttcagtttaagcacttgcttctctcagtttaaactccacttccttagggatgtctctgtgacctccctgtgctggattagcttccctactctatgctcttgtaaaacactatctacttcctttgtcataaactcatcattttcctataaacattaatattgtcctcctgctagaatgtaagctccgtgagagcaaggatcctcctgtttaccctgtacctccaatgtctggcacttgtaggtgctcaaatattcgttgaatgaatgaaaaatccatattgtaattgatgtcctctggccacatagttttaaaattaggtgattgattatatgaccgaatagaactatcaaatgttttcctaataaagtcaatatttcaaa

SEQ ID NO: 153366 - DNA, 1214 bp, Homo sapiens
  Payload ID: 10167
  Gene Symbol: MCCC2
  Gene Name: methylcrotonoyl-CoA carboxylase 2 (beta)
  ENST ID: ENST00000509358
  CDS Start-End: 97-1188
acctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggtataaaggtgaagaattgaaaatacgaacattttctgctgctttg

SEQ ID NO: 153367 - DNA, 2127 bp, Homo sapiens
  Payload ID: 10167
  Gene Symbol: MCCC2
  Gene Name: methylcrotonoyl-CoA carboxylase 2 (beta)
  ENST ID: ENST00000512218
  CDS Start-End: 139-1128
acaggcctgagaatcagagaaaccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacaggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggtataaagcccttggaaaagcacaagacataaatcttctttgaactttcttttgaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttacggttatcctttctgacccacaaagtatgaaaagttctgtaatctgtaaactcagttctgtaatctgtattattgagatgattaatataaagttgtattttcactgaaa

SEQ ID NO: 153368 - DNA, 895 bp, Homo sapiens
  Payload ID: 10167
  Gene Symbol: MCCC2
  Gene Name: methylcrotonoyl-CoA carboxylase 2 (beta)
  ENST ID: ENST00000509539
  CDS Start-End: 38-895
gggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagagaaattcttcatgaaatattttctacggctagatcttaattcctataatagtacttggcaacatggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaa

SEQ ID NO: 153369 - DNA, 753 bp, Homo sapiens
  Payload ID: 10167
  Gene Symbol: MCCC2
  Gene Name: methylcrotonoyl-CoA carboxylase 2 (beta)
  ENST ID: ENST00000616108
  CDS Start-End: 130-753
agaatcagagaaaccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacag

SEQ ID NO: 153370 - DNA, 720 bp, Homo sapiens
  Payload ID: 10167
  Gene Symbol: MCCC2
  Gene Name: methylcrotonoyl-CoA carboxylase 2 (beta)
  ENST ID: ENST00000613643
  CDS Start-End: 97-720
acctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacag

SEQ ID NO: 153371 - DNA, 720 bp, Homo sapiens; identical to SEQ ID NO: 153370
  Payload ID: 10167
  Gene Symbol: MCCC2
  Gene Name: methylcrotonoyl-CoA carboxylase 2 (beta)
  ENST ID: ENST00000626890
  CDS Start-End: 97-720

SEQ ID NO: 153372 - DNA, 744 bp, Homo sapiens
  Payload ID: 10167
  Gene Symbol: MCCC2
  Gene Name: methylcrotonoyl-CoA carboxylase 2 (beta)
  ENST ID: ENST00000628716
  CDS Start-End: 121-744
gaaaccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacag

SEQ ID NO: 153373 - DNA, 1128 bp, Homo sapiens
  Payload ID: 10167
  Gene Symbol: MCCC2
  Gene Name: methylcrotonoyl-CoA carboxylase 2 (beta)
  ENST ID: ENST00000629193
  CDS Start-End: 139-1128
acaggcctgagaatcagagaaaccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacaggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggtataaagcccttggaaaagcacaagacataa

SEQ ID NO: 153374 - DNA, 762 bp, Homo sapiens
  Payload ID: 10167
  Gene Symbol: MCCC2
  Gene Name: methylcrotonoyl-CoA carboxylase 2 (beta)
  ENST ID: ENST00000628261
  CDS Start-End: 139-762
acaggcctgagaatcagagaaaccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacag

SEQ ID NO: 153375 - DNA, 3136 bp, Homo sapiens
  Payload ID: 10168
  Gene Symbol: MTHFD1
  Gene Name: methylenetetrahydrofolate dehydrogenase (NADP+ dependent) 1, methenyltetrahydrofolate cyclohydrolase, formyltetrahydrofo late synthetase
  Uniprot ID: P11586
  ENST ID: ENST00000216605
  CDS Start-End: 79-2886
gttgtcctgcttggctgcggagggagtggaacctcgatattggtggtgtccatcgtgggcagcggactaataaaggccatggcgccagcagaaatcctgaacgggaaggagatctccgcgcaaataagggcgagactgaaaaatcaagtcactcagttgaaggagcaagtacctggtttcacaccacgcctggcaatattacaggttggcaacagagatgattccaatctttatataaatgtgaagctgaaggctgctgaagagattgggatcaaagccactcacattaagttaccaagaacaaccacagaatctgaggtgatgaagtacattacatctttgaatgaagactctactgtacatgggttcttagtgcagctacctttagattcagagaattccattaacactgaagaagtgatcaatgctattgcacccgagaaggatgtggatggattgactagcatcaatgctgggaaacttgctagaggtgacctcaatgactgtttcattccttgtacgcctaagggatgcttggaactcatcaaagagacaggggtgccgattgccggaaggcatgctgtggtggttgggcgcagtaaaatagttggggccccgatgcatgacttgcttctgtggaacaatgccacagtgaccacctgccactccaagactgcccatctggatgaggaggtaaataaaggtgacatcctggtggttgcaactggtcagcctgaaatggttaaaggggagtggatcaaacctggggcaatagtcatcgactgtggaatcaattatgtcccagatgataaaaaaccaaatgggagaaaagttgtgggtgatgtggcatacgacgaggccaaagagagggcgagcttcatcactcctgttcctggcggcgtagggcccatgacagttgcaatgctcatgcagagcacagtagagagtgccaagcgtttcctggagaaatttaagccaggaaagtggatgattcagtataacaaccttaacctcaagacacctgttccaagtgacattgatatatcacgatcttgtaaaccgaagcccattggtaagctggctcgagaaattggtctgctgtctgaagaggtagaattatatggtgaaacaaaggccaaagttctgctgtcagcactagaacgcctgaagcaccggcctgatgggaaatacgtggtggtgactggaataactccaacacccctgggagaagggaaaagcacaactacaatcgggctagtgcaagcccttggtgcccatctctaccagaatgtctttgcgtgtgtgcgacagccttctcagggccccacctttggaataaaaggtggcgctgcaggaggcggctactcccaggtcattcctatggaagagtttaatctccacctcacaggtgacatccatgccatcactgcagctaataacctcgttgctgcggccattgatgctcggatatttcatgaactgacccagacagacaaggctctctttaatcgtttggtgccatcagtaaatggagtgagaaggttctctgacatccaaatccgaaggttaaagagactaggcattgaaaagactgaccctaccacactgacagatgaagagataaacagatttgcaagattggacattgatccagaaaccataacttggcaaagagtgttggataccaatgatagattcctgaggaagatcacgattggacaggctccaacggagaagggtcacacacggacggcccagtttgatatctctgtggccagtgaaattatggctgtcctggctctcaccacttctctagaagacatgagagagagactgggcaaaatggtggtggcatccagtaagaaaggagagcccgtcagtgccgaagatctgggggtgagtggtgcactgacagtgcttatgaaggacgcaatcaagcccaatctcatgcagacactggagggcactccagtgtttgtccatgctggcccgtttgccaacatcgcacatggcaattcctccatcattgcagaccggatcgcactcaagcttgttggcccagaagggtttgtagtgacggaagcaggatttggagcagacattggaatggaaaagttttttaacatcaaatgccggtattccggcctctgcccccacgtggtggtgcttgttgccactgtcagggctctcaagatgcacgggggcggccccacggtcactgctggactgcctcttcccaaggcttacatacaggagaacctggagctggttgaaaaaggcttcagtaacttgaagaaacaaattgaaaatgccagaatgtttggaattccagtagtagtggccgtgaatgcattcaagacggatacagagtctgagctggacctcatcagccgcctttccagagaacatggggcttttgatgccgtgaagtgcactcactgggcagaagggggcaagggtgccttagccctggctcaggccgtccagagagcagcacaagcacccagcagcttccagctcctttatgacctcaagctcccagttgaggataaaatcaggatcattgcacagaagatctatggagcagatgacattgaattacttcccgaagctcaacacaaagctgaagtctacacgaagcagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacgatgagcacaatgcctggactccccacccggccctgtttttatgatattgatttggaccctgaaacagaacaggtgaatggattattctaaacagatcaccatccatcttcaagaagctactttgaaagtctggccagtgtctattcaggcccactgggagttaggaagtataagtaagccaagagaagtcagcccctgcccagaagatctgaaactaatagtaggagtttccccagaagtcattttcagccttaattctcatcatgtataaattaacataaatcatgcatgtctgtttactttagtgacgttccacagaataaaaggaaacaagtttgcc

SEQ ID NO: 153376 - DNA, 6814 bp, Homo sapiens
  Payload ID: 10168
  Gene Symbol: MTHFD1
  Gene Name: methylenetetrahydrofolate dehydrogenase (NADP+ dependent) 1, methenyltetrahydrofolate cyclohydrolase, formyltetrahydrofo late synthetase
  ENST ID: ENST00000545908
  CDS Start-End: 230-3292
gattggctggaattacggccggattccggagtcctttccagctccctcttcggccgggtttcccgccgaatacaaaggcgcactgtgaactggctctttctttccgccaatcatttccgccagccattcatcaccgattttcttcatcttcccctccctcttccgtcccgcagtccccgacctgttagctctcggttagttaagggactcgggtccttccgaactgcgcatgcgccaccgcgtctgcagggggagaagcgggcaggggcgcaggcgcagtagtgtgatcccctggccagtccctaagcacgtgggttgggttgtcctgcttggctgcggagggagtggaacctcgatattggtggtgtccatcgtgggcagcggactaataaaggccatggcgccagcagaaatcctgaacgggaaggagatctccgcgcaaataagggcgagactgaaaaatcaagtcactcagttgaaggagcaagtacctggtttcacaccacgcctggcaatattacaggttggcaacagagatgattccaatctttatataaatgtgaagctgaaggctgctgaagagattgggatcaaagccactcacattaagttaccaagaacaaccacagaatctgaggtgatgaagtacattacatctttgaatgaagactctactgtacatgggttcttagtgcagctacctttagattcagagaattccattaacactgaagaagtgatcaatgctattgcacccgagaaggatgtggatggattgactagcatcaatgctgggaaacttgctagaggtgacctcaatgactgtttcattccttgtacgcctaagggatgcttggaactcatcaaagagacaggggtgccgattgccggaaggcatgctgtggtggttgggcgcagtaaaatagttggggccccgatgcatgacttgcttctgtggaacaatgccacagtgaccacctgccactccaagactgcccatctggatgaggaggtaaataaaggtgacatcctggtggttgcaactggtcagcctgaaatggttaaaggggagtggatcaaacctggggcaatagtcatcgactgtggaatcaattatgtcccagatgataaaaaaccaaatgggagaaaagttgtgggtgatgtggcatacgacgaggccaaagagagggcgagcttcatcactcctgttcctggcggcgtagggcccatgacagttgcaatgctcatgcagagcacagtagagagtgccaagcgtttcctggagaaatttaagccaggaaagtggatgattcagtataacaaccttaacctcaagacacctgttccaagtgacattgatatatcacgatcttgtaaaccgaagcccattggtaagctggctcgagaaattggtctgctgtctgaagaggtagaattatatggtgaaacaaaggccaaagttctgctgtcagcactagaacgcctgaagcaccggcctgatgggaaatacgtggtggtgactggaataactccaacacccctgggagaagggaaaagcacaactacaatcgggctagtgcaagcccttggtgcccatctctaccagaatgtctttgcgtgtgtgcgacagccttctcagggccccacctttggaataaaaggtggcgctgcaggaggcggctactcccaggtcattcctatggaagagtttaatctccacctcacaggtgacatccatgccatcactgcagctaataacctcgttgctgcggccattgatgctcggatatttcatgaactgacccagacagacaaggctctctttaatcgtttggtgccatcagtaaatggagtgagaaggttctctgacatccaaatccgaaggttaaagagactaggcattgaaaagactgaccctaccacactgacagatgaagagataaacagatttgcaagattggacattgatccagaaaccataacttggcaaagagtgttggataccaatgatagattcctgaggaagatcacgattggacaggctccaacggagaagggtcacacacggacggcccagtttgatatctctgtggccagtgaaattatggctgtcctggctctcaccacttctctagaagacatgagagagagactgggcaaaatggtggtggcatccagtaagaaaggagagcccgtcagtgccgaagatctgggggtgagtggtgcactgacagtgcttatgaaggacgcaatcaagcccaatctcatgcagacactggagggcactccagtgtttgtccatgctggcccgtttgccaacatcgcacatggcaattcctccatcattgcagaccggatcgcactcaagcttgttggcccagaagggtttgtagtgacggaagcaggatttggagcagacattggaatggaaaagttttttaacatcaaatgccggtattccggcctctgcccccacgtggtggtgcttgttgccactgtcagggctctcaagatgcacgggggcggccccacggtcactgctggactgcctcttcccaaggcttacatacaggagaacctggagctggttgaaaaaggcttcagtaacttgaagaaacaaattgaaaatgccagaatgtttggaattccagtagtagtggccgtgaatgcattcaagacggatacagagtctgagctggacctcatcagccgcctttccagagaacatggggcttttgatgccgtgaagtgcactcactgggcagaagggggcaagggtgccttagccctggctcaggccgtccagagagcagcacaagcacccagcagcttccagctcctttatgacctcaagctcccagttgaggataaaatcaggatcattgcacagaagatctatggagcagatgacattgaattacttcccgaagctcaacacaaagctgaagtctacacgaagcagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacgatcaccatccatcttcaagaagctactttgaaagtctggccagtgtctattcaggcccactgggagttaggaagtataagtaagccaagagaagtcagcccctgcccagaagatctgaaactaatagtaggagtttccccagaagtcattttcagccttaattctcatcatgtataaattaacataaatcatgcatgtctgtttactttagtgacgttccacagaataaaaggaaacaagtttgccatcttggtgttgcaatatgaattacagccttaacagactgtgccacaggtctctgccatcctttgtgagctcatttgtcaggcagacccttgggctgaagatgcaagttgcagtgtgccctttatgatactgttgtgtttagagggaaatgtatgcatgcttgtgtatttctgagaggacacataattcaggggacctcctgagagggttgggttggaagttgatgacttaccttttaatcttatacctttctatattgttgaattttgtttttctaccctgaggaagtattgcttatacaagtttttgcctgaacttccttggaattcccatttctgtcacagctttagcactgtctatgtttagagtgctcaagaaggatggtcatgcagcattagccttaggtgagcctctattctgttggtgcagcaagtattcattgagtttcttctaaatgcctgggctccacccttccctacagactttttatttttatttttatttttttgagacagtgtctctgtcgcccaggctggagtgcagtggcgcgatctcagctcactgcaacctccgtctcctgggttcaagtgattctcctgcctcagcctcccaagtagctgggattataggcatgagccaccatacctggcccagactttctttttcctaaaacattaggttggtaaaaaccacaattacttttgcaccaacctaatattttttttcctcctcttctggctgggcgtggaggtggctcatgcctgtaatcccagcactttgggaggccgaggtgggcggatcacttgaggtctggggttcaagaccagcttggccaacatggtaaaaccctgtttctaccaaaaatacaaaaattagctgggtgtggtggcaggcacctataaccccaggtacttgggaggctgaggtacgagaattgcttgaacccaggaggcagaggttgcagtgagccaggatcatgctgctgcactccagcctgggagacagagctagactctgtctaaaaaaataaatcaaatatttttccttctcttcttgttctttatcttctatctctgttcttcctctcccatttgtttccttccctttttccccttgtctccctccactggatccttccagaggatgctgcatcccactggcgccagtgctaaacactgctgatgttggcaaagcagtatttttcccagtgaccttggttttattatttttaattccctaggtccatgtcaatgttgtaatacagtcaattttacagtccacagaaatgatagcgctgccttgagaggcatatggcaaaggggtcacagtgcagagccccagctctatggcagagagcctcacccacctccctgcctccacatcctcaccatggaaataggagcactgttggtacctacctcgtgagggcggttctggaattactcaaacacatcatctaagatgctttgtacagggcctggcacattgtaagcacttgtcagttcctgttgcacagcatcctccaggccctgtttgcagagttaattgcttctggtactttttttttccttttttttttttttttttggcagggggggtaggggggttgggacaagagtcgtgctcttttgcccaggctgcagtgtagtgacgtgatctcagctcactgcaacctctgcctcccgggttcaagcgattctcccacctcagcctcccgagtagctgggattacaggttcgcaccaccatgcctggctaattttttgtattttcagtatagatggggttttgccatgttggccaggctggtctcaaactcctggcctcaagtgatcctcccacctcggcctcccaaagtgctgggattacaggcgtgagccactgtgcccgaccgctttctggtacatttcttaatgtcctgtgaaacttcacctggaatgggatttgctgggaattcattttgtagacaagggaaggatgcagtcttgtcagatatggtgacttaaggatcatcttaaaggatttaggtttcctaatatcgccaacagccacatgggtttaaatcctcaatactggtaggggctgggcatggtagctcacacctgtaatcccaccacactcagctgagttttgaagttctgttttttgtagagatggggtctcactgtcttgtccaggctgctgaggcaggaggatcacttgagcccaggagttcaagactaacctggacaagacagaccccatctctacaaaaaacaaaaccccaaaactcagctgagtgtgtggtgcacgcttgtagtcctagctccttgggagtctgatgtgagaggtttgcttgagcctaggagttcgaggccgcagtgagctatgactgagccaccgcattccagcctgagcaacagagcaagaccctgtgtcaaaataaaaaagacctatagaagcattagtgcttggggtaactattagcatgtgctggcagagaaggtctagtgcctttaccttggtgctaagagtccctccagattagtggctttcccgtgccctttctcttctctgggctgctaatgccttccttccccttattagtaatattactgataaacaaattgtacattctctgatctcacttcagaggctgtttctgtgcactgaagatgtacacacagtcttaattcaaaagagatagcatttatgtgctgccacattaaacagattgcaacagtattactattgagtttgtgttggctctgtgcaaccctcatggtgcccaggaacagatgaaaccaccagagacttggagcctcaggttcattcaatggtgtcccagggaacggggttggagggcttattcccagaaggcctctgaaatgtaagagctattaacaaggagttataagtcatttttggtagctataggcccaggcaatgggtagagatcaagatgggataaatggtaagatcagtagagtattgctcagataaatatgtaagctattttactggcacactgtatctagtgatattaacatgataagctataggtaggataatttctcatcagattgcagaaatacatttatagcctatttcctgttatataatgaaaagctactaatggggtagtagacaatgatatgggtaatagcttaaacagccttcgttgtcacttacctgaattcaggaatgacaggtttctttcatgcatgaggtactggatacattaaacacacacacacacacacacacacacacacacatatggcattgagttctagtcatatcctaaagaaaaactatggtgcgctatgttatttatagtactatactctgtgtgagtgactctgtgtgtatgtgtgttggtggaggtcagggatgacttgtttgtaatataccttaaggaagtctgtccgaatttgcccttcaaatactaaataaattcatctctcacctcaaa

SEQ ID NO: 153377 - DNA, 803 bp, Homo sapiens
  Payload ID: 10168
  Gene Symbol: MTHFD1
  Gene Name: methylenetetrahydrofolate dehydrogenase (NADP+ dependent) 1, methenyltetrahydrofolate cyclohydrolase, formyltetrahydrofo late synthetase
  Uniprot ID: P11586
  ENST ID: ENST00000555709
  CDS Start-End: 21-803
cgggtccttccgaactgcgcatgcgccaccgcgtctgcagggggagaagcgggcaggggcgcaggcgcagtagtgtgatcccctggccagtccctaagcacgtgggttgggttgtcctgcttggctgcggagggagtggaacctcgatattggtggtgtccatcgtgggcagcggactaataaaggccatggcgccagcagaaatcctgaacgggaaggagatctccgcgcaaataagggcgagactgaaaaatcaagtcactcagttgaaggagcaagtacctggtttcacaccacgcctggcaatattacaggttggcaacagagatgattccaatctttatataaatgtgaagctgaaggctgctgaagagattgggatcaaagccactcacattaagttaccaagaacaaccacagaatctgaggtgatgaagtacattacatctttgaatgaagactctactgtacatgggttcttagtgcagctacctttagattcagagaattccattaacactgaagaagtgatcaatgctattgcacccgagaaggatgtggatggattgactagcatcaatgctgggaaacttgctagaggtgacctcaatgactgtttcattccttgtacgcctaagggatgcttggaactcatcaaagagacaggggtgccgattgccggaaggcatgctgtggtggttgggcgcagtaaaatagttggggccccgatgcatgacttgcttctgtggaacaatgccacagtgaccacctgccactccaagactgcccatctggatgaggag

SEQ ID NO: 153378 - DNA, 509 bp, Homo sapiens
  Payload ID: 10168
  Gene Symbol: MTHFD1
  Gene Name: methylenetetrahydrofolate dehydrogenase (NADP+ dependent) 1, methenyltetrahydrofolate cyclohydrolase, formyltetrahydrofo late synthetase
  ENST ID: ENST00000557539
  CDS Start-End: 304-509
gctggtgactttctgccgggagagtgggtagttgcggcttcctggagcccccctagtcagaactcagaaatccaatctacttaattcccgttaatttggaggcaaataagggcgagactgaaaaatcaagtcactcagttgaaggagcaagtacctggtttcacaccacgcctggcaatattacaggttggcaacagagatgattccaatctttatataaatgtgaagctgaaggctgctgaagagattgggatcaaagccactcacattaagttaccaagaacaaccacagaatctgaggtgatgaagtacattacatctttgaatgaagactctactgtacatgggttcttagtgcagctacctttagattcagagaattccattaacactgaagaagtgatcaatgctattgcacccgagaaggatgtggatggattgactagcatcaatgctgggaaacttgctagaggtgacctcaatgactgtttcattccttgtacgcctaa

SEQ ID NO: 153379 - DNA, 571 bp, Homo sapiens
  Payload ID: 10168
  Gene Symbol: MTHFD1
  Gene Name: methylenetetrahydrofolate dehydrogenase (NADP+ dependent) 1, methenyltetrahydrofolate cyclohydrolase, formyltetrahydrofo late synthetase
  ENST ID: ENST00000557370
  CDS Start-End: 1-324
tatgacctcaagctcccagttgaggataaaatcaggatcattgcacagaagatctatggagcagatgacattgaattacttcccgaagctcaacacaaagctgaagtctacacgaagcagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacggtaagtgcatgctgcaagggagtagtgggcgcatctgcacttctcgtctgaagtgtgttgccgaaaccatcaagcaaatgccaagtgagcagagttcactgcccagaagaaaattggaatcgggcctattatgattgctgtggatcataagctataaagcaggagctatatagctcttgctgtggaccatcttggtgtcaaatcaagaatgatgccaggactactcatactgaataaaaaattctgtttcccagggacagtatgctcttcactgaatctaggatgagcccagttgata

SEQ ID NO: 153380 - DNA, 688 bp, Homo sapiens
  Payload ID: 10168
  Gene Symbol: MTHFD1
  Gene Name: methylenetetrahydrofolate dehydrogenase (NADP+ dependent) 1, methenyltetrahydrofolate cyclohydrolase, formyltetrahydrofo late synthetase
  ENST ID: ENST00000554739
  CDS Start-End: 620-688
agtagtgtgatcccctggccagtccctaagcacgtgggttgggttgtcctgcttggctgcggagggagtggaacctcgatattggtggtgtccatcgtgggcagcggactaataaaggccatggcgccagcagaaatcctgaacgggaaggagatctccgcccatctctctgccctggtcctagagttacttgaaacgtaatttggctcctgagtcctgagaatattctgcattccacttgacctctgcctgttctacccttgcgggacatctgaatgcttaattactgctgccttgagatctatttttttttttgagatgaagtcttgctgtgtccaatcttggctcactgcaacctctgcctcctgcatacaagcaattctctcatatcagcctcctgagtacctgggattacaggcaaataagggcgagactgaaaaatcaagtcactcagttgaaggagcaagtacctggtttcacaccacgcctggcaatattacaggttggcaacagagatgattccaatctttatataaatgtgaagctgaaggctgctgaagagattgggatcaaagccactcacattaagttaccaagaacaaccacagaatctgaggtgatgaagtacattacatctttgaatgaagactctactgtacatgggttcttagtgcagctacctttagat

SEQ ID NO: 153381 - DNA, 563 bp, Homo sapiens
  Payload ID: 10168
  Gene Symbol: MTHFD1
  Gene Name: methylenetetrahydrofolate dehydrogenase (NADP+ dependent) 1, methenyltetrahydrofolate cyclohydrolase, formyltetrahydrofo late synthetase
  ENST ID: ENST00000554768
  CDS Start-End: 489-563
agtagtgtgatcccctggccagtccctaagcacgtgggttgggttgtcctgcttggctgcggagggagtggaacctcgatattggtggtgtccatcgtgggcagcggactaataaaggccatggcgccagcagaaatcctgaacgggaaggagatctccgcccatctctctgccctggtcctagagttacttgaaacgtaatttggctcctgagtcctgagaatattctgcattccacttgacctctgcctgttctacccttgcgggacatctgaatgcttaattagcaaataagggcgagactgaaaaatcaagtcactcagttgaaggagcaagtacctggtttcacaccacgcctggcaatattacaggttggcaacagagatgattccaatctttatataaatgtgaagctgaaggctgctgaagagattgggatcaaagccactcacattaagttaccaagaacaaccacagaatctgaggtgatgaagtacattacatctttgaatgaagactctactgtacatgggttcttagtgcagctacctttagattcagag

SEQ ID NO: 153382 - DNA, 1049 bp, Homo sapiens
  Payload ID: 10169
  Gene Symbol: MTHFD1L
  Gene Name: methylenetetrahydrofolate dehydrogenase (NADP+ dependent) 1-like
  Uniprot ID: Q6UB35
  ENST ID: ENST00000367307
  CDS Start-End: 108-935
tccttcccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagacggagtctcgttctgtcaccaggctggagtgcaggcgcgtgatctaggctcactgcaagctctgcctcccaggttgaagtgattctcctgtgaaagggaattatttttgatgagtcattaaagtatatccattcccagaatggtgctgcatttttcctttt

SEQ ID NO: 153383 - DNA, 996 bp, Homo sapiens
  Payload ID: 10169
  Gene Symbol: MTHFD1L
  Gene Name: methylenetetrahydrofolate dehydrogenase (NADP+ dependent) 1-like
  ENST ID: ENST00000367308
  CDS Start-End: 1-996
gtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaa

SEQ ID NO: 153384 - DNA, 3604 bp, Homo sapiens
  Payload ID: 10169
  Gene Symbol: MTHFD1L
  Gene Name: methylenetetrahydrofolate dehydrogenase (NADP+ dependent) 1-like
  Uniprot ID: Q6UB35
  ENST ID: ENST00000367321
  CDS Start-End: 275-3211
tgagtcccactccgcaccccaccctctgtctggtacagcttaccaaaccaaagtgcccaaagccgtgacatcccggccggcggctcgcaggcccccgccctccgcacgtcacggccgccgggtgcagtgccccctaggggcccctgggacgaggaggaagcgccaggtccttcccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaa

SEQ ID NO: 153385 - DNA, 503 bp, Homo sapiens
  Payload ID: 10169
  Gene Symbol: MTHFD1L
  Gene Name: methylenetetrahydrofolate dehydrogenase (NADP+ dependent) 1-like
  ENST ID: ENST00000453602
  CDS Start-End: 1-279
gtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgagaagctcccctctggctctagttggagaatcccaacccaagcaagtccatccttaaacaataaacatctccagcattgctggctttggaagaccccatggtgagatgctggagcttttttccgctccagatttcgcttctaaatatttacttttactttccatgttcacttataggccagggtttttttttcctaccattgaattatttcgtcatgttctatttaattattgctttaattggcattggtgaccacaaataataataaatactattaactg

SEQ ID NO: 153386 - DNA, 606 bp, Homo sapiens
  Payload ID: 10169
  Gene Symbol: MTHFD1L
  Gene Name: methylenetetrahydrofolate dehydrogenase (NADP+ dependent) 1-like
  ENST ID: ENST00000420192
  CDS Start-End: 1-291
aacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcagccattctcttgatcccagtgggggctggatgaaggaagagcaaaacaaaccacgaagacagcctggagccgcagccagctctgctgacttctgaacttcacgctctcactgcccagatggccaggggtgtttcctcctctgctggtcttttttaaggcaggatgtttgttgttattgttgttgtttttctggttggttcttaagaaattattttctacatcttgaaaatgccagctggaacctacaccagttgttggtggggtgtgagaactatcctttacatggacttggagcatttgcaactagagcctccacattgaaataaac

SEQ ID NO: 153387 - DNA, 427 bp, Homo sapiens
  Payload ID: 10169
  Gene Symbol: MTHFD1L
  Gene Name: methylenetetrahydrofolate dehydrogenase (NADP+ dependent) 1-like
  ENST ID: ENST00000450635
  CDS Start-End: 1-174
aatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgggaggcagagaagctcccctctggctctagttggagaatcccaacccaagcaagtccatccttaaacaataaacatctccagcattgctggctttggaagaccccatggtgagatgctggagcttttttccgctccagatttcgcttctaaatatttacttttactttccatgttcacttataggccagggtttttttttcctaccattgaattatttcgtcatgttctatttaattattgctttaattggcattggtgaccacaaataataataaatactat

SEQ ID NO: 153388 - DNA, 524 bp, Homo sapiens
  Payload ID: 10169
  Gene Symbol: MTHFD1L
  Gene Name: methylenetetrahydrofolate dehydrogenase (NADP+ dependent) 1-like
  ENST ID: ENST00000423867
  CDS Start-End: 183-524
gtgcgcccttccccgcgcgcggcccctcctgctgggctggggtctgtggctgacgtccgcttttcccggaacggcaaagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttg

SEQ ID NO: 153389 - DNA, 1134 bp, Homo sapiens
  Payload ID: 10169
  Gene Symbol: MTHFD1L
  Gene Name: methylenetetrahydrofolate dehydrogenase (NADP+ dependent) 1-like
  ENST ID: ENST00000441122
  CDS Start-End: 234-560
gggagaggcgggctcgggcccagcgccgcccgcgcgaagctccctggtgttgtgcgcccttccccgcgcgcggcccctcctgctgggctggggtctgtggctgacgtccgcttttcccggaacggcaaagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcc

SEQ ID NO: 153390 - DNA, 3475 bp, Homo sapiens
  Payload ID: 10169
  Gene Symbol: MTHFD1L
  Gene Name: methylenetetrahydrofolate dehydrogenase (NADP+ dependent) 1-like
  ENST ID: ENST00000611279
  CDS Start-End: 145-3084
cccctaggggcccctgggacgaggaggaagcgccaggtccttcccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaacc

SEQ ID NO: 153391 - DNA, 3159 bp, Homo sapiens
  Payload ID: 10169
  Gene Symbol: MTHFD1L
  Gene Name: methylenetetrahydrofolate dehydrogenase (NADP+ dependent) 1-like
  ENST ID: ENST00000618312
  CDS Start-End: 27-2768
acgtgcgcagccggccgccggctctgatgcaatcgcgccgggcgcgacccagacgagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaacc

SEQ ID NO: 153392 - DNA, 4456 bp, Homo sapiens
  Payload ID: 10170
  Gene Symbol: MTHFD2
  Gene Name: methylenetetrahydrofolate dehydrogenase (NADP+ dependent) 2, methenyltetrahydrofolate cyclohydrolase
  Uniprot ID: P13995
  ENST ID: ENST00000394053
  CDS Start-End: 81-1133
cggggcctgccacgaggccgcagtataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtatggtatgaatttctgaaattctgtcttcctatgactcctagttgtgacctaaccagtttttttctcatttaatcaatgtagctattcctatattcagtaacacttacttctatagccttaaatagataattttttttcttctatttttttttttttttttgtagagatggggtcttgctatgttgcctgggctggtattgaactcctggcctcaagcaatcaatcctcttgcctcagcttcccagagggctgggattacaggcctgggccacccacacccaaacagaggtttaaagagctttggagaaaccagcctcgtcctccagtctctttgtttgtttgttttgagactgagtcttgctctgttgcccaggctggagtgcagtggcatgatctcgggtcactgcaacctctgcctctcgggttcaaacaattcttgtgcctcagcctcctgagtagctgggattacaggtgcatgccaccatgcctggctaatttttgtgtttttagtagagatggggtttcatcacattggccaggctggtctcaaactcctgacctcaagtgatccacctgcctcggcctcccaaaatgctaggattacaggcgtgagccactgcacctggcctgtcctacagtcttatatcacaacaggttgtgccaagctaggagcttaatctgtaaaatacttgaggcagggataggtttgtctgttttggcttttggctttcatgcgagcagaagtagctcctgctctaggcagcttgaggcagaaagagaagaaacaattgagttgacctacctccgtcctcgttcttctgccagctggcgttattcttttgatagttctctggagtttaaagaagtttagatagtttgctggagatgtttttgtaagtgacgtatagcttatgtctctaatccatgcctgcttacctagattattaaatgtggagcaagatgaccagacaggattaaattttattgaattacagttacaagtggaaaaaatgactgacttactgcatggagaagtattatgtcaacctgttaaaagctatggaaattaaaatgttcatgtatatacaaaatataaatgacatgtaaggtaaaattacagtgatcaatttacaacaaagaaattaacagtagttttccagcttgtttgattaatcaagcaggtttactcttgaatccatagcatttctacaatttaatttggacaaagttctattccagatcagccaggttttaaaactgaaatgtgttaagggtggattgttagcttccccaggattggtgtggatgataaatactttttttaaaaattaattattattgtttataagacatggattccagctgtctccctggctggagtgcagtggcatgattatagctcactgcagccttgaactcctggacttaaacgatcctcctgcatcagcctctgaaatggctgggactacaggtgtgtgccagcatgcctagctaatttttaaacatttgtttagagatgggtctcactatgttgcccaggctggtcttgacctcctgacctctgctgattccccccacctctgcctcccaagtagcgggattacaggtgtgagccactgtgtctgacaagaatttatacttaagcataggagatggttctggaaattctaagaaattctgctctcagtaagagtagaggtttggagctttacctcttggcagtatcccttggaagggagctctgagattaaatgtaatcaaacacttattgagagctttctatggaccaggcactacactagacgctgggaattacagaggcaattacctgtcctatactcaaggtgttaatgatctagtgtcatttttctttaaaaaagaaagcacctgcatttgtcatcttgagcaaatatagtaactctaacctcaaggttcaagtgatttactcaaggtttaaatcatagttgttttggagaaagtaagtgtcagatgcactgtggctgtcagggtcatagtaggcattaaatcaacatggttggtgttcattaaatgtggattgaagataaaatgactgatcttaagtttcatgaggaataggtttgcttcattgaaactggtttttatcttcccaaatagttttcaatcattcctttaaagtactaggttgattaatattgcaaagttgtaatgtaaaatgtgaccttacctctgtctaacctgtattgttcacatgaatgggagtttgactttgggaataaacattgaaaatttgcagggaggaccca

SEQ ID NO: 153393 - DNA, 1757 bp, Homo sapiens
  Payload ID: 10170
  Gene Symbol: MTHFD2
  Gene Name: methylenetetrahydrofolate dehydrogenase (NADP+ dependent) 2, methenyltetrahydrofolate cyclohydrolase
  ENST ID: ENST00000409804
  CDS Start-End: 33-701
cttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtatggtatgaatttctgaaa

SEQ ID NO: 153394 - DNA, 1865 bp, Homo sapiens
  Payload ID: 10170
  Gene Symbol: MTHFD2
  Gene Name: methylenetetrahydrofolate dehydrogenase (NADP+ dependent) 2, methenyltetrahydrofolate cyclohydrolase
  ENST ID: ENST00000409601
  CDS Start-End: 27-830
tcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtggagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctg

SEQ ID NO: 153395 - DNA, 1396 bp, Homo sapiens
  Payload ID: 10170
  Gene Symbol: MTHFD2
  Gene Name: methylenetetrahydrofolate dehydrogenase (NADP+ dependent) 2, methenyltetrahydrofolate cyclohydrolase
  ENST ID: ENST00000470592
  CDS Start-End: 30-143
ccctcccggcgcagtcaccggcgcggtctatggctgcgacttctctaatgtctgctttggctgcccggctgctgcagcccgcgcacagctgctcccttcgccttcgccctttccacctcgcggcagttcggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgatt

SEQ ID NO: 153396 - DNA, 1135 bp, Homo sapiens
  Payload ID: 10170
  Gene Symbol: MTHFD2
  Gene Name: methylenetetrahydrofolate dehydrogenase (NADP+ dependent) 2, methenyltetrahydrofolate cyclohydrolase
  ENST ID: ENST00000489041
  CDS Start-End: 28-138
ctcccggcgcagtcaccggcgcggtctatggctgcgacttctctaatgtctgctttggctgcccggctgctgcagcccgcgcacagctgctcccttcgccttcgccctttccacctcgcggcagttcgagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactca

SEQ ID NO: 153397 - DNA, 2300 bp, Homo sapiens
  Payload ID: 10171
  Gene Symbol: MTHFD2L
  Gene Name: methylenetetrahydrofolate dehydrogenase (NADP+ dependent) 2-like
  Uniprot ID: Q9H903
  ENST ID: ENST00000325278
  CDS Start-End: 141-1010
gcggccgccttggccgagcgccggcgttgggcagaagcacagcaccctccgtaagggcaccgggagagcccgggagtgcgttccggggctttcggagcagcggtgtgagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaagctgttaaaaagaaagctggctttatcactccagttccaggaggtgtgggacccatgacagtggcaatgcttctgaagaacacccttctggcagctaaaaaaatcatttactagatcacatgaaaggataaagcaaactgaagtcatgctatttgtttatttgacaaagggtaaaacctttatattttactacaaagctatttatttctacatggtatttattttttcatgggtgaaatcattgtgaatcaattgattcacatagttttatgcatttcctgctaatttattttgagttttaagaaaacaaccaaaacaattccaatgaaaattttagtaacaattgtttattttgagggtatttgttcataacattaaaacaataaagggctcataataaataaatatatttttgacacaattaaatattacatagagtatgtttacaacaaatatcctgtcagccaaatggttacccatataaaatgtaatttaggttttgctacttgcatgctaacatttttaatgtattttatgatctatgtcatatattaaaaaagagcttgcttactacaagaaaaatattgaaatattgaaaatattgaaaatattattattgaaaataaaatcttgatctcaactatcccccaaatgcatcctataagtccatcctaatgagaaatgatgttctatttaaggaaaggaaaatattccgggaaggcaaaaaatgcagtgctgtttggaagtgtaatgattttatcacatggtgaatgactactaagagtaatgattatatcacattgtgaatgactacttgccacagtaaaaatacatgaagaatgtgttaggtttaaacgtcgtttctttcttctaaaaaatatttggttagtaccttcactgagcaatagtggaaaaataaaaaaataagtaaacagaaaaaactaaagttgtattttcccacaaatatagtatgaatgaggtcatattaaagaacagcaactgttaatgtttgttcacaaattcagaaatctaataggaaaacatgatactttcaatgtgccaaaactaaaccttagtatacaactaaaaatctcctgccttcttgcctacctgtcttccctcttctgttacagaatttgttcctcaaagtagatgcaatgtttctaacacaatttaaattaggaaatatatatgaatgtcgttgaagtctattttgagactgctaaagctattaattgatactgtgtttttatgcccaaatcccagtatgtttatgtaccaataatgactcttacccagcgcatgtctttatcagtgtgtactcgtgacgatttgtgtgaaaatagacttgatgtttataattaataccattacaactgtataataaaagcaatttgaagaaaa

SEQ ID NO: 153398 - DNA, 954 bp, Homo sapiens
  Payload ID: 10171
  Gene Symbol: MTHFD2L
  Gene Name: methylenetetrahydrofolate dehydrogenase (NADP+ dependent) 2-like
  ENST ID: ENST00000359107
  CDS Start-End: 198-954
ggtccgcggcttctcgctgctccgcggccgccttggccgagcgccggcgttgggcagaagcacagcaccctccgtaagggcaccgggagagcccgggagtgcgttccggggctttcggagcagcggtgtgaggaccagcagagagaagagattccatcttccagagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaag

SEQ ID NO: 153399 - DNA, 2354 bp, Homo sapiens
  Payload ID: 10171
  Gene Symbol: MTHFD2L
  Gene Name: methylenetetrahydrofolate dehydrogenase (NADP+ dependent) 2-like
  Uniprot ID: Q9H903
  ENST ID: ENST00000395759
  CDS Start-End: 28-1071
cagtccggaagccggggatccgcggccatgacggtgccggtccgcggcttctcgctgctccgcggccgccttggccgagcgccggcgttgggcagaagcacagcaccctccgtaagggcaccgggagagcccgggagtgcgttccggggctttcggagcagcggtgtgagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaagctgttaaaaagaaagctggctttatcactccagttccaggaggtgtgggacccatgacagtggcaatgcttctgaagaacacccttctggcagctaaaaaaatcatttactagatcacatgaaaggataaagcaaactgaagtcatgctatttgtttatttgacaaagggtaaaacctttatattttactacaaagctatttatttctacatggtatttattttttcatgggtgaaatcattgtgaatcaattgattcacatagttttatgcatttcctgctaatttattttgagttttaagaaaacaaccaaaacaattccaatgaaaattttagtaacaattgtttattttgagggtatttgttcataacattaaaacaataaagggctcataataaataaatatatttttgacacaattaaatattacatagagtatgtttacaacaaatatcctgtcagccaaatggttacccatataaaatgtaatttaggttttgctacttgcatgctaacatttttaatgtattttatgatctatgtcatatattaaaaaagagcttgcttactacaagaaaaatattgaaatattgaaaatattgaaaatattattattgaaaataaaatcttgatctcaactatcccccaaatgcatcctataagtccatcctaatgagaaatgatgttctatttaaggaaaggaaaatattccgggaaggcaaaaaatgcagtgctgtttggaagtgtaatgattttatcacatggtgaatgactactaagagtaatgattatatcacattgtgaatgactacttgccacagtaaaaatacatgaagaatgtgttaggtttaaacgtcgtttctttcttctaaaaaatatttggttagtaccttcactgagcaatagtggaaaaataaaaaaataagtaaacagaaaaaactaaagttgtattttcccacaaatatagtatgaatgaggtcatattaaagaacagcaactgttaatgtttgttcacaaattcagaaatctaataggaaaacatgatactttcaatgtgccaaaactaaaccttagtatacaactaaaaatctcctgccttcttgcctacctgtcttccctcttctgttacagaatttgttcctcaaagtagatgcaatgtttctaacacaatttaaattaggaaatatatatgaatgtcgttgaagtctattttgagactgctaaagctattaattgatactgtgtttttatgcccaaatcccagtatgtttatgtaccaataatgactcttacccagcgcatgtctttatcagtgtgtactcgtgacgatttgtgtgaaaatagacttgatgtttataattaataccattacaactgtataataaaagcaatttg

SEQ ID NO: 153400 - DNA, 2007 bp, Homo sapiens
  Payload ID: 10171
  Gene Symbol: MTHFD2L
  Gene Name: methylenetetrahydrofolate dehydrogenase (NADP+ dependent) 2-like
  ENST ID: ENST00000423607
  CDS Start-End: 240-560
gccccagtccggaagccggggatccgcggccatgacggtgccggtccgcggcttctcgctgctccgcggccgccttggccgagcgccggcgttgggcagaagcacagcaccctccgtaagggcaccgggagagcccgggagtgcgttccggggctttcggagcagcggtgtgaggaccagcagagagaagagattccatcttccagagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaagctgtgcaactttgttcaggatttgaaatgctcgggatataagagtacacaggcttgctctttgtccagtagctgaccctaaagctaaggagaaataaaaatgaccgaatgcagatgctttcctactcctgtcctgaccgtgcagagattcttatcaataagtggtcactttgtcgagttgtctagtttgaagcctttgaggattagcaccttccagtttattcaagggaattggacaaagaaatgagaatgaactataggattaaaggataaaactaaagaagattgagcccatgtgactactggacaatagattgtaaaaggaagagacatttttggaaccacttccagactgagatggttaaaagctgttgtgccctcctccttcacttctgtttctgttgcattgttcttggaaactaggtattacagatggttgtaaattacaaaaagtagggcagtagaattcttattggacttgacatgaataagaaataaatacccttttataaatgactgggatttcagatttttttaaacctataaactcacagatcaaagaagctcaccaaactctcaagctcatgaaacatgaagaaaactatgccaaagaacaccataatcaaattattcaaaaccactgatagaaaaaaatcttaaaagcaataagggggttgggggagggcattacatacaaaggaacaaagaggacagtgacagaatatttattgatagaaacaatgcaagcaagaagacaatagaacaatatctttaagtattaagaggaaaaaaaacacctgtaaacccaaatttctatacctagtgaaaataccttcaaaaacaaaggcaaaaagtcttttatgagacatgtgaggaagagagctcaaaactaaaaacaattatttactagcagacctatgatctaagaaatactaaaaggcccgggtgtggtggctcatgcctgtaatccctgcccttgtgggtggatcacttgaggtcaggagttcaagaccagcctggccaacatcgggaaaccccatctctactgaaaatacaaaaatcagctgggcattgtggtgcacacctgtaatcacagctactcaggaggttgagacaggaggattgcttggacctgggaagtggaggttggagtgagccaagatcatgccactggactccagcctgggcaacagagcaagactccatctcaacaaccacaacaaaaaagagatattaaaggaagtccttcacctagatggaaatgatactagatggaaatatggatctgtccaaggaattaagagctctggaagtggtaactacctgaataaatatatattattcatgtatatatatgttataatatattgttcttattcttattattcagattattttagaagataattaatgtttaaccaaagccaaaaacaatgtagtttgtggtttgtaacatacaattaaaatgtatggcaacaatagcacaaaa

SEQ ID NO: 153401 - DNA, 1798 bp, Homo sapiens
  Payload ID: 10171
  Gene Symbol: MTHFD2L
  Gene Name: methylenetetrahydrofolate dehydrogenase (NADP+ dependent) 2-like
  Uniprot ID: Q9H903
  ENST ID: ENST00000429519
  CDS Start-End: 524-1195
ctcgttcaccagagcacctactatgttccaggtggtatcataagaacttgggagacatcactaaacaaaatagaaaaatccctgcccttatggagctgacattctagtgggggcttggtttttttccttgggtactgggtttgtttttccatgatgagcatatcctatgatgcactatagcactcaagcaagatgcctgaagcaaaggaggccaaagtaatgattcatggattcagcacactttcctttgttgaaaagcactgcttgttccccctcaaagctatgtgagaggctgtgtaggagagagtggagagcaggtagcctaccggacctacagttcaccatttcagccctgtaattgaccagctgtgggacctcagtgtgaagcttattcatgaagagacctctgcctgaacatacagcaaatttaagaaggttgtgcagatagtctgaaggaggaccagcagagagaagagattccatcttccagagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcagagagatttcaccattttgcccaggacctctccaactcctgaactcaagcgatccacctgcctcagcttcccaaagtgctgagattacaggcatgagccaccacacccggcactatataagtattttagaccttagaaaaacctatctagttttaaatttgtcttattaattttcttgacattgctaaaaaaagaagcatgtatatccattcatgcaatattcctcagcagtgaaaaggaatgaactattgatacagcaacctgaatgaatttccagcaaattatgaagtaaaaaaggcaatctcacatgttctttgttcaatcatagaatatatgattccatttatatagcattcttgaaagtgacaaaattagcggtttccgggagtcaaggacaggttgatgtgggagggaactgggtgtggctgtaataaggcaacatgagggacccttttgatgatggaaatgttctatatcttaactgtatcaatgtcaatatcctgggtataatattgtcctgtagtttggcaagatattatcattgtatagtatcttgtattatttcttacaatggatgtgaatctataattatcaaaaaatgacaatttaattaaagcatatagtaaataagtaaaaaaataaaaa

SEQ ID NO: 153402 - DNA, 1407 bp, Homo sapiens
  Payload ID: 10171
  Gene Symbol: MTHFD2L
  Gene Name: methylenetetrahydrofolate dehydrogenase (NADP+ dependent) 2-like
  ENST ID: ENST00000433372
  CDS Start-End: 377-817
agtgtgaagcttattcatgaagagacctctgcctgaacatacagcaaatttaagaaggttgtgcagatagtctgaaggaggaccagcagagagaagagattccatcttccagagacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcagagagatttcaccattttgcccaggacctctccaactcctgaactcaagcgatccacctgcctcagcttcccaaagtgctgagattacaggcatgagccaccacacccggcactatataagtattttagaccttagaaaaacctatctagttttaaatttgtcttattaattttcttgacattgctaaaaaaagaagcatgtatatccattcatgcaatattcctcagcagtgaaaaggaatgaactattgatacagcaacctgaatgaatttccagcaaattatgaagtaaaaaaggcaatctcacatgttctttgttcaatcatagaatatatgattccatttatatagcattcttgaaagtgacaaaattagcggtttccgggagtcaaggacaggttgatgtgggagggaactgggtgtggctgtaataaggcaacatgagggacccttttgatgatggaaatgttctatatcttaactgtatcaatgtcaatatcctgggtataatattgtcctgtagtttggcaagatattatcattgtatagtatcttgtattatttcttacaatggatgtgaatctataattatcaaaaaatgacaatttaattaaagcatatagtaaataagt

SEQ ID NO: 153403 - DNA, 786 bp, Homo sapiens
  Payload ID: 10171
  Gene Symbol: MTHFD2L
  Gene Name: methylenetetrahydrofolate dehydrogenase (NADP+ dependent) 2-like
  ENST ID: ENST00000429335
  CDS Start-End: 265-585
agtgtaaatatgacttctaagctggctgttgctctactgctttcttggcagttgcatgctttctgtagcactgtgtgaagtgtgaagcttattcatgaagagacctctgcctgaacatacagcaaatttaagaaggttgtgcagatagtctgaaggaggctggtgcagcatggaaacacggatttgagctcattactccaattttcacgctgagtttggaagggtcctagaggacatgaagccattattatatcaggaaccgaaatggccaagcatatccagaaagaaatacagcgaggtgtggaatcatgggtttcccttggaaacagaagacctcacctcagtataattttagtgggagataacccagcaagccatacatatgtcaggaataagataagagctgcctctgctgtaggtatttgtagtgagctcattctaaaacctaaggatgtttctcaggaagaacttttggacgtaactgatcaattgaatatggacccaagagtcagcggtatattagttcagttaccactaccagaagctgtgcaactttgttcaggatttgaaatgctcgggatataagagtacacaggcttgctctttgtccagtagctgaccctaaagctaaggagaaataaaaatgaccgaatgcagatgctttcctactcctgtcctgaccgtgcagagattcttatcaataagtggtcactttgtcgagttgtctagtttgaagcctttgaggattagcaccttccagtttattcaagggaattggacaaagaa

SEQ ID NO: 153404 - DNA, 1135 bp, Homo sapiens
  Payload ID: 10172
  Gene Symbol: MTHFR
  Gene Name: methylenetetrahydrofolate reductase (NAD(P)H)
  ENST ID: ENST00000376486
  CDS Start-End: 1047-1135
ctccaaataaccaccctcctcttcaggacacctcaaagatgtccaacgccagctgaaaaggggggtaaaaatgcaggttccatttgacagtgtgacgtatctgaaatcagaaaggacttgtcaactctgggaacacaactcaagttttcccaggatgctttgcagggggaagctggactgtcagtgacccagaaagggtgagggatagagtgagaaaggactggagaagctaaaacagcagcatgataagcacaaagtcctgtgaggaagctcattctgaaaacgcttgtttcattccaaactcttttcagatggaaataaaaggaaacatgggtgggatttactggagctggcctggattctccctcagattccaggaggggttatgagaaaagaccccagacttaggcacgtgaagcagggtagacgcttcgagagccctggctgcggtccccaggccccacccgctgccacctgcgggcccagattggcccggccccacccccggcaacgcctctctcagtcccttagcaaccgccccctccccaggccgactccgccggcttcttaccagctcctcgggggtgcgggtctcacgctcaccgcagcagcagcaccacctgcagcagcagcacagagaccccctgcaccccgccatcttcctcctttactgccactctggacccctctaccaaccccctcccagccaggatctgcgcctcacgtgactggccccgggacggtcacgtggccctctcgagctctgggactgagaccaggagtggctgcagacgggtggggcgaggactcgcgtcacatgacgataaaggcacggcctccaacgagacctgtgggcacggccatgttgggggcggggcttccggtcacccgcgccggtggtttccgccctgtaggcccgcctctccagcaacctgacacctgcgccgcgccccttcactgcgttccccgcccctgcagcggccacagtggtgcggccggcggccgagcgttctgagtcacccgggactggaggtaggaacccagccatggtgaacgaagccagaggaaacagcagcctcaacccctgcttggagggcagtgccagcagtggcagtgagagctccaaagatagttc

SEQ ID NO: 153405 - DNA, 7044 bp, Homo sapiens
  Payload ID: 10172
  Gene Symbol: MTHFR
  Gene Name: methylenetetrahydrofolate reductase (NAD(P)H)
  Uniprot ID: P42898
  ENST ID: ENST00000376583
  CDS Start-End: 1-2094
atggaccatcgaaaagccagggtcctcccagctgggcactactgcccctcgctaggaatatgggcctcgcaggtcggcagcgtgaggtcctctgtgccaccttccatcagtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggagacccaataggtgaccagtgggaagaggaggagggaggcttcaactacgcagtggacctggtgaagcacatccgaagtgagtttggtgactactttgacatctgtgtggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacaccctcaaccgcgagatggctaccacagaggtgctgaagcgcctggggatgtggactgaggaccccaggcgtcccctaccctgggctctcagcgcccaccccaagcgccgagaggaagatgtacgtcccatcttctgggcctccagaccaaagagttacatctaccgtacccaggagtgggacgagttccctaacggccgctggggcaattcctcttcccctgcctttggggagctgaaggactactacctcttctacctgaagagcaagtcccccaaggaggagctgctgaagatgtggggggaggagctgaccagtgaagaaagtgtctttgaagtcttcgttctttacctctcgggagaaccaaaccggaatggtcacaaagtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggcctacttagagtttttcacttcccgcgagacagcggaagcacttctgcaagtgctgaagaagtacgagctccgggttaattaccaccttgtcaatgtgaagggtgaaaacatcaccaatgcccctgaactgcagccgaatgctgtcacttggggcatcttccctgggcgagagatcatccagcccaccgtagtggatcccgtcagcttcatgttctggaaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacacttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagcacaggggccccagatctgcctgggcctgtgcagcagcccagcttcctggtgtatttttcaggtaggcccttgtcctgccagctgccttcctcatcccctcgtcctgtcccagaggttatctgcctggcctggctccccacgagtcacctgcaagccccagggcctgggggcagtgactggcaggtgcagatgggctgtttcgtgtagtggaagagcagcctgatggccaagggggtggacgcaattgtgggatgtcctctttactcccttcctggcctcactggctggggcagaggggcagccgctaggagagactgaaagcagcagctaggactgaggagtgggttttattgtccttcagagctcttcaagctgtcccctctgtcatcactccctggatgtgtggggcatggttccttccctgggaaggctaagttcagttctgttttttattctatgagaacaagtcacagctgcagctgggccccatgctctgccccaagcccccaaccccgcggtgctctggcggcttcctgtccactctcggggcccttggggcctggcttgctccagggtcttgggctactggcagctcctctccttgggctcctggctgccaggcgttggtgccacttcttaaaggcctggaaccagggaggagaggaaatgctattgttgtgggctttctccggggtctgtgctgtgcctgctagagcaacccctgtacccagctccttttgtccccagggcccctccctctgccccaagcagccagccagtcttgcctaggccaaatgcacaagctcagaatagatctgatggtgagctgggaagctgtactcagagcagagcaaatgagggagggggcgctcaggacccaggccctccatgggctagtgtgagtggcagccatgcctcatgccacaccttcttcgcaaactgatggaccgggtgggcctggcctgagctggggccacaaatcaaagcaagggctccagcatccagcctgtgtgttctgtaatggaactgaccccctcccctgaaaacgaaggggccccggggctggcaagcagggaaagctccacggtgcgtggctgtggcacagacttctggaaggctggctgagtggaatgcagggaagagggcagtacctgggaaaggacccacccatcttcctgctgctgtaactgctgagccactcgcagtcgcaggatccgctgccaccacgtctgccaggcccatctcaggtgccactccctgagctttggggacagttggcagagaaggcctcttgtgctcacgctcccccgcagtccccagcccttctgcctttctcccccgacactgctgcaccagagtgaaagggctatggcaagggggtgtcatctgaggagtattaagaatgcagattcctgggcctgtcccccaaggttttggagtcagtaggtccaagggccatacttttgagaggggtttgggttaagtatgaggtgaaatgggagatggtcagtgtggagaggggtgcacccactcaccagggtccgcaccagctgctctgccccttgggcatccacccagtgctgccatgccactgccaggcacctggcctgctgggaaccccgcagcccgtgaagcagtgcctcgaggcaccggcgctgcaggtacttcctcctgatggccaagagcatcgtgacccttcagggccagaaggagggcagagccatgggcctgggcctgcttttccaggatcctgcaggaacgagcactggccagagagggcccagctgtagccatggctcaggcaagcccctcagcccttgcccccatccctcggacccaccaaactgcacacacagctcctcttaccgtagcctccgtttatgggccttgctttgggctttgcaggctctgggctcagggctggagtgcgctcttggtccctggtccctcgtccacaggggcaggcctgggacccagctactctgtccaggccactgtggccagagctggaaggcagggcagagggaatgttccctgcaccctggaaaggggagttgagtcacaagaggttaaggtgggtccaggaaggcagctgctcttagtgcccgcctaggagttgagtacagtgaggagggtggaggaaggtgctgagcttagccttgtgccctgcccccatctccccaggcctccagcctctcccggctgcctgccgcccaaagagaaatcacaggggcggggcaggaatgcaaagtgttttctcagaacagctgaaacattccgaagagggaatggatggggagaatggtcaatacacataagaccgtgtcccaaggagctgatttccaggcccctgaggactggagaccgcttcacccctgcacttcagacaccgtttgtcccccggggcaaggtctccttactctgagcccaggccgttccccttggcttcctccgtccacccaggctgcactgcagtgatggcgcgggaggcaccagctctgtggcctgtgtccagcagctgcgggtctgaaggaatagccagagaggagcacctgaaccccatgggcttggacttcctggggccccgctgggatttcttcgctgctctagctggcaggacacatcccggcctcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaacgtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctatcaacctcttatcaccacttgttggtgtcagaactaactgcttctggtctggagagggactgaccgatgcctttgggtagagagaattatgaaagaaattttggtatttttctactttatattttctgaggtttctgtaataagcatatttcacttttccaataagaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcgtggtggcgtgcacttgtagtcccagctactcaggaagctgaggcgggagaatcacttgaacccgggaggcagaggttgcagtgagctgagatcactcctctgcttcagcctgggcaattgagccagactctgtctcaaaaataaacaaaaaaacttgac

SEQ ID NO: 153406 - DNA, 5532 bp, Homo sapiens
  Payload ID: 10172
  Gene Symbol: MTHFR
  Gene Name: methylenetetrahydrofolate reductase (NAD(P)H)
  Uniprot ID: P42898
  ENST ID: ENST00000376585
  CDS Start-End: 1053-3146
gtccgccgggacctttctgggagtcgtaggcttaatgaccctatgccctctgttggcctgtctgtgccctggtggctctgattacttgtttctgttttttgtttttgtttttttttttgagatggagttttgcttttgtcgcccaggctggagtgctatggcacaatcttggttcactgcaacctctgccttccgggttcaagcgattctcctgcctcagcctccagagtagctgggattacaggcgcccgccaccaaacctggctaatttttatatttttagtagagtcgggatttcaccatgttggccaggctggtctcaaactcctggcctcaggtgatccacccacctcggcctcccaaagtgctgggattacaggtgtgttttttgtttttttaagagatggagtctcgctatgttgcccaggctggccttgaactcctgggctcaggcaatccttctgcctcagccttcccagtagctgggtcactgtgatgatttgaattgaattctgtgatgtgtaagaagagcagcctgcaaggcaagcacagatggggcagcttttgttctgagaaattcgtgcccttactgaacttgggtctggctatttttggaacatggccagcatcaagttctaacccacaacacggtctttttggagtagcatgaattcaggagaaatctggctgcatagtcaagccctcaccccttccatcctgtgcacgaactgtttcaagtaacagatgttccaggcagagccagccagagtgagctgttccttctctggagggtgatctggtatccctgaacgcctgttggcctcatctccaccaacccctgcagtctctgcccctgagtccccctccttccatccgcctccccttactagagcctcagccctccctcctcgcctggaagccttgcccccgcccccttgtgctggctggagctcaagcctcttcctttgtcgcagctccgcccagttgaacacacccgctggggaaggtgcctctgttccctccccacgcactctgggcctgagctgacagagatggaccatcgaaaagccagggtcctcccagctgggcactactgcccctcgctaggaatatgggcctcgcaggtcggcagcgtgaggtcctctgtgccaccttccatcagtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggagacccaataggtgaccagtgggaagaggaggagggaggcttcaactacgcagtggacctggtgaagcacatccgaagtgagtttggtgactactttgacatctgtgtggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacaccctcaaccgcgagatggctaccacagaggtgctgaagcgcctggggatgtggactgaggaccccaggcgtcccctaccctgggctctcagcgcccaccccaagcgccgagaggaagatgtacgtcccatcttctgggcctccagaccaaagagttacatctaccgtacccaggagtgggacgagttccctaacggccgctggggcaattcctcttcccctgcctttggggagctgaaggactactacctcttctacctgaagagcaagtcccccaaggaggagctgctgaagatgtggggggaggagctgaccagtgaagaaagtgtctttgaagtcttcgttctttacctctcgggagaaccaaaccggaatggtcacaaagtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggcctacttagagtttttcacttcccgcgagacagcggaagcacttctgcaagtgctgaagaagtacgagctccgggttaattaccaccttgtcaatgtgaagggtgaaaacatcaccaatgcccctgaactgcagccgaatgctgtcacttggggcatcttccctgggcgagagatcatccagcccaccgtagtggatcccgtcagcttcatgttctggaaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacacttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagcacaggggccccagatctgcctgggcctgtgcagcagcccagcttcctggtgtatttttcaggtaggcccttgtcctgccagctgccttcctcatcccctcgtcctgtcccagaggttatctgcctggcctggctccccacgagtcacctgcaagccccagggcctgggggcagtgactggcaggtgcagatgggctgtttcgtgtagtggaagagcagcctgatggccaagggggtggacgcaattgtgggatgtcctctttactcccttcctggcctcactggctggggcagaggggcagccgctaggagagactgaaagcagcagctaggactgaggagtgggttttattgtccttcagagctcttcaagctgtcccctctgtcatcactccctggatgtgtggggcatggttccttccctgggaaggctaagttcagttctgttttttattctatgagaacaagtcacagctgcagctgggccccatgctctgccccaagcccccaaccccgcggtgctctggcggcttcctgtccactctcggggcccttggggcctggcttgctccagggtcttgggctactggcagctcctctccttgggctcctggctgccaggcgttggtgccacttcttaaaggcctggaaccagggaggagaggaaatgctattgttgtgggctttctccggggtctgtgctgtgcctgctagagcaacccctgtacccagctccttttgtccccagggcccctccctctgccccaagcagccagccagtcttgcctaggccaaatgcacaagctcagaatagatctgatggtgagctgggaagctgtactcagagcagagcaaatgagggagggggcgctcaggacccaggccctccatgggctagtgtgagtggcagccatgcctcatgccacaccttcttcgcaaactgatggaccgggtgggcctggcctgagctggggccacaaatcaaagcaagggctccagcatccagcctgtgtgttctgtaatggaactgaccccctcccctgaaaacgaaggggccccggggctggcaagcagggaaagctccacggtgcgtggctgtggcacagacttctggaaggctggctgagtggaatgcagggaagagggcagtacctgggaaaggacccacccatcttcctgctgctgtaactgctgagccactcgcagtcgcaggatccgctgccaccacgtctgccaggcccatctcaggtgccactccctgagctttggggacagttggcagagaaggcctcttgtgctcacgctcccccgcagtccccagcccttctgcctttctcccccgacactgctgcaccagagtgaaagggctatggcaagggggtgtcatctgaggagtattaagaatgcagattcctgggcctgtcccccaaggttttggagtcagtaggtccaagggccatacttttgagaggggtttgggttaagtatgaggtgaaatgggagatggtcagtgtggagaggggtgcacccactcaccagggtccgcaccagctgctctgccccttgggcatccacccagtgctgccatgccactgccaggcacctggcctgctgggaaccc

SEQ ID NO: 153407 - DNA, 6232 bp, Homo sapiens
  Payload ID: 10172
  Gene Symbol: MTHFR
  Gene Name: methylenetetrahydrofolate reductase (NAD(P)H)
  Uniprot ID: P42898
  ENST ID: ENST00000376590
  CDS Start-End: 185-2155
atgttgggggcggggcttccggtcacccgcgccggtggtttccgccctgtaggcccgcctctccagcaacctgacacctgcgccgcgccccttcactgcgttccccgcccctgcagcggccacagtggtgcggccggcggccgagcgttctgagtcacccgggactggaggtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggagacccaataggtgaccagtgggaagaggaggagggaggcttcaactacgcagtggacctggtgaagcacatccgaagtgagtttggtgactactttgacatctgtgtggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacaccctcaaccgcgagatggctaccacagaggtgctgaagcgcctggggatgtggactgaggaccccaggcgtcccctaccctgggctctcagcgcccaccccaagcgccgagaggaagatgtacgtcccatcttctgggcctccagaccaaagagttacatctaccgtacccaggagtgggacgagttccctaacggccgctggggcaattcctcttcccctgcctttggggagctgaaggactactacctcttctacctgaagagcaagtcccccaaggaggagctgctgaagatgtggggggaggagctgaccagtgaagaaagtgtctttgaagtcttcgttctttacctctcgggagaaccaaaccggaatggtcacaaagtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggcctacttagagtttttcacttcccgcgagacagcggaagcacttctgcaagtgctgaagaagtacgagctccgggttaattaccaccttgtcaatgtgaagggtgaaaacatcaccaatgcccctgaactgcagccgaatgctgtcacttggggcatcttccctgggcgagagatcatccagcccaccgtagtggatcccgtcagcttcatgttctggaaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacacttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagcacaggggccccagatctgcctgggcctgtgcagcagcccagcttcctggtgtatttttcaggtaggcccttgtcctgccagctgccttcctcatcccctcgtcctgtcccagaggttatctgcctggcctggctccccacgagtcacctgcaagccccagggcctgggggcagtgactggcaggtgcagatgggctgtttcgtgtagtggaagagcagcctgatggccaagggggtggacgcaattgtgggatgtcctctttactcccttcctggcctcactggctggggcagaggggcagccgctaggagagactgaaagcagcagctaggactgaggagtgggttttattgtccttcagagctcttcaagctgtcccctctgtcatcactccctggatgtgtggggcatggttccttccctgggaaggctaagttcagttctgttttttattctatgagaacaagtcacagctgcagctgggccccatgctctgccccaagcccccaaccccgcggtgctctggcggcttcctgtccactctcggggcccttggggcctggcttgctccagggtcttgggctactggcagctcctctccttgggctcctggctgccaggcgttggtgccacttcttaaaggcctggaaccagggaggagaggaaatgctattgttgtgggctttctccggggtctgtgctgtgcctgctagagcaacccctgtacccagctccttttgtccccagggcccctccctctgccccaagcagccagccagtcttgcctaggccaaatgcacaagctcagaatagatctgatggtgagctgggaagctgtactcagagcagagcaaatgagggagggggcgctcaggacccaggccctccatgggctagtgtgagtggcagccatgcctcatgccacaccttcttcgcaaactgatggaccgggtgggcctggcctgagctggggccacaaatcaaagcaagggctccagcatccagcctgtgtgttctgtaatggaactgaccccctcccctgaaaacgaaggggccccggggctggcaagcagggaaagctccacggtgcgtggctgtggcacagacttctggaaggctggctgagtggaatgcagggaagagggcagtacctgggaaaggacccacccatcttcctgctgctgtaactgctgagccactcgcagtcgcaggatccgctgccaccacgtctgccaggcccatctcaggtgccactccctgagctttggggacagttggcagagaaggcctcttgtgctcacgctcccccgcagtccccagcccttctgcctttctcccccgacactgctgcaccagagtgaaagggctatggcaagggggtgtcatctgaggagtattaagaatgcagattcctgggcctgtcccccaaggttttggagtcagtaggtccaagggccatacttttgagaggggtttgggttaagtatgaggtgaaatgggagatggtcagtgtggagaggggtgcacccactcaccagggtccgcaccagctgctctgccccttgggcatccacccagtgctgccatgccactgccaggcacctggcctgctgggaaccccgcagcccgtgaagcagtgcctcgaggcaccggcgctgcaggtacttcctcctgatggccaagagcatcgtgacccttcagggccagaaggagggcagagccatgggcctgggcctgcttttccaggatcctgcaggaacgagcactggccagagagggcccagctgtagccatggctcaggcaagcccctcagcccttgcccccatccctcggacccaccaaactgcacacacagctcctcttaccgtagcctccgtttatgggccttgctttgggctttgcaggctctgggctcagggctggagtgcgctcttggtccctggtccctcgtccacaggggcaggcctgggacccagctactctgtccaggccactgtggccagagctggaaggcagggcagagggaatgttccctgcaccctggaaaggggagttgagtcacaagaggttaaggtgggtccaggaaggcagctgctcttagtgcccgcctaggagttgagtacagtgaggagggtggaggaaggtgctgagcttagccttgtgccctgcccccatctccccaggcctccagcctctcccggctgcctgccgcccaaagagaaatcacaggggcggggcaggaatgcaaagtgttttctcagaacagctgaaacattccgaagagggaatggatggggagaatggtcaatacacataagaccgtgtcccaaggagctgatttccaggcccctgaggactggagaccgcttcacccctgcacttcagacaccgtttgtcccccggggcaaggtctccttactctgagcccaggccgttccccttggcttcctccgtccacccaggctgcactgcagtgatggcgcgggaggcaccagctctgtggcctgtgtccagcagctgcgggtctgaaggaatagccagagaggagcacctgaaccccatgggcttggacttcctggggccccgctgggatttcttcgctgctctagctggcaggacacatcccggcctcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaaaaaaaaaa

SEQ ID NO: 153408 - DNA, 7057 bp, Homo sapiens
  Payload ID: 10172
  Gene Symbol: MTHFR
  Gene Name: methylenetetrahydrofolate reductase (NAD(P)H)
  Uniprot ID: P42898
  ENST ID: ENST00000376592
  CDS Start-End: 130-2100
gccttcttcctgtgtggaaatacagcgcctccggcttgaacctgccactcaggtgtcttgatgtgtcgggggtgtggctgcctgccccctgatgctccctgccccaccctgtgcagtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggagacccaataggtgaccagtgggaagaggaggagggaggcttcaactacgcagtggacctggtgaagcacatccgaagtgagtttggtgactactttgacatctgtgtggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacaccctcaaccgcgagatggctaccacagaggtgctgaagcgcctggggatgtggactgaggaccccaggcgtcccctaccctgggctctcagcgcccaccccaagcgccgagaggaagatgtacgtcccatcttctgggcctccagaccaaagagttacatctaccgtacccaggagtgggacgagttccctaacggccgctggggcaattcctcttcccctgcctttggggagctgaaggactactacctcttctacctgaagagcaagtcccccaaggaggagctgctgaagatgtggggggaggagctgaccagtgaagaaagtgtctttgaagtcttcgttctttacctctcgggagaaccaaaccggaatggtcacaaagtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggcctacttagagtttttcacttcccgcgagacagcggaagcacttctgcaagtgctgaagaagtacgagctccgggttaattaccaccttgtcaatgtgaagggtgaaaacatcaccaatgcccctgaactgcagccgaatgctgtcacttggggcatcttccctgggcgagagatcatccagcccaccgtagtggatcccgtcagcttcatgttctggaaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacacttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagcacaggggccccagatctgcctgggcctgtgcagcagcccagcttcctggtgtatttttcaggtaggcccttgtcctgccagctgccttcctcatcccctcgtcctgtcccagaggttatctgcctggcctggctccccacgagtcacctgcaagccccagggcctgggggcagtgactggcaggtgcagatgggctgtttcgtgtagtggaagagcagcctgatggccaagggggtggacgcaattgtgggatgtcctctttactcccttcctggcctcactggctggggcagaggggcagccgctaggagagactgaaagcagcagctaggactgaggagtgggttttattgtccttcagagctcttcaagctgtcccctctgtcatcactccctggatgtgtggggcatggttccttccctgggaaggctaagttcagttctgttttttattctatgagaacaagtcacagctgcagctgggccccatgctctgccccaagcccccaaccccgcggtgctctggcggcttcctgtccactctcggggcccttggggcctggcttgctccagggtcttgggctactggcagctcctctccttgggctcctggctgccaggcgttggtgccacttcttaaaggcctggaaccagggaggagaggaaatgctattgttgtgggctttctccggggtctgtgctgtgcctgctagagcaacccctgtacccagctccttttgtccccagggcccctccctctgccccaagcagccagccagtcttgcctaggccaaatgcacaagctcagaatagatctgatggtgagctgggaagctgtactcagagcagagcaaatgagggagggggcgctcaggacccaggccctccatgggctagtgtgagtggcagccatgcctcatgccacaccttcttcgcaaactgatggaccgggtgggcctggcctgagctggggccacaaatcaaagcaagggctccagcatccagcctgtgtgttctgtaatggaactgaccccctcccctgaaaacgaaggggccccggggctggcaagcagggaaagctccacggtgcgtggctgtggcacagacttctggaaggctggctgagtggaatgcagggaagagggcagtacctgggaaaggacccacccatcttcctgctgctgtaactgctgagccactcgcagtcgcaggatccgctgccaccacgtctgccaggcccatctcaggtgccactccctgagctttggggacagttggcagagaaggcctcttgtgctcacgctcccccgcagtccccagcccttctgcctttctcccccgacactgctgcaccagagtgaaagggctatggcaagggggtgtcatctgaggagtattaagaatgcagattcctgggcctgtcccccaaggttttggagtcagtaggtccaagggccatacttttgagaggggtttgggttaagtatgaggtgaaatgggagatggtcagtgtggagaggggtgcacccactcaccagggtccgcaccagctgctctgccccttgggcatccacccagtgctgccatgccactgccaggcacctggcctgctgggaaccccgcagcccgtgaagcagtgcctcgaggcaccggcgctgcaggtacttcctcctgatggccaagagcatcgtgacccttcagggccagaaggagggcagagccatgggcctgggcctgcttttccaggatcctgcaggaacgagcactggccagagagggcccagctgtagccatggctcaggcaagcccctcagcccttgcccccatccctcggacccaccaaactgcacacacagctcctcttaccgtagcctccgtttatgggccttgctttgggctttgcaggctctgggctcagggctggagtgcgctcttggtccctggtccctcgtccacaggggcaggcctgggacccagctactctgtccaggccactgtggccagagctggaaggcagggcagagggaatgttccctgcaccctggaaaggggagttgagtcacaagaggttaaggtgggtccaggaaggcagctgctcttagtgcccgcctaggagttgagtacagtgaggagggtggaggaaggtgctgagcttagccttgtgccctgcccccatctccccaggcctccagcctctcccggctgcctgccgcccaaagagaaatcacaggggcggggcaggaatgcaaagtgttttctcagaacagctgaaacattccgaagagggaatggatggggagaatggtcaatacacataagaccgtgtcccaaggagctgatttccaggcccctgaggactggagaccgcttcacccctgcacttcagacaccgtttgtcccccggggcaaggtctccttactctgagcccaggccgttccccttggcttcctccgtccacccaggctgcactgcagtgatggcgcgggaggcaccagctctgtggcctgtgtccagcagctgcgggtctgaaggaatagccagagaggagcacctgaaccccatgggcttggacttcctggggccccgctgggatttcttcgctgctctagctggcaggacacatcccggcctcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaacgtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctatcaacctcttatcaccacttgttggtgtcagaactaactgcttctggtctggagagggactgaccgatgcctttgggtagagagaattatgaaagaaattttggtatttttctactttatattttctgaggtttctgtaataagcatatttcacttttccaataagaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcgtggtggcgtgcacttgtagtcccagctactcaggaagctgaggcgggagaatcacttgaacccgggaggcagaggttgcagtgagctgagatcactcctctgcttcagcctgggcaattgagccagactctgtctcaaaaataaacaaaaaaacttgacaaaaaaa

SEQ ID NO: 153409 - DNA, 1539 bp, Homo sapiens
  Payload ID: 10172
  Gene Symbol: MTHFR
  Gene Name: methylenetetrahydrofolate reductase (NAD(P)H)
  ENST ID: ENST00000423400
  CDS Start-End: 1382-1539
gtccgccgggacctttctgggagtcgtaggcttaatgaccctatgccctctgttggcctgtctgtgccctggtggctctgattacttgtttctgttttttgtttttgtttttttttttgagatggagttttgcttttgtcgcccaggctggagtgctatggcacaatcttggttcactgcaacctctgccttccgggttcaagcgattctcctgcctcagcctccagagtagctgggattacaggcgcccgccaccaaacctggctaatttttatatttttagtagagtcgggatttcaccatgttggccaggctggtctcaaactcctggcctcaggtgatccacccacctcggcctcccaaagtgctgggattacaggtgtgttttttgtttttttaagagatggagtctcgctatgttgcccaggctggccttgaactcctgggctcaggcaatccttctgcctcagccttcccagtagctgggtcactgtgatgatttgaattgaattctgtgatgtgtaagaagagcagcctgcaaggcaagcacagatggggcagcttttgttctgagaaattcgtgcccttactgaacttgggtctggctatttttggaacatggccagcatcaagttctaacccacaacacggtctttttggagtagcatgaattcaggagaaatctggctgcatagtcaagccctcaccccttccatcctgtgcacgaactgtttcaagtaacagatgttccaggcagagccagccagagtgagctgttccttctctggagggtgatctggtatccctgaacgcctgttggcctcatctccaccaacccctgcagtctctgcccctgagtccccctccttccatccgcctccccttactagagcctcagccctccctcctcgcctggaagccttgcccccgcccccttgtgctggctggagctcaagcctcttcctttgtcgcagctccgcccagttgaacacacccgctggggaaggtgcctctgttccctccccacgcactctgggcctgagctgacagagatggaccatcgaaaagccagggtcctcccagctgggcactactgcccctcgctaggaatatgggcctcgcaggtcggcagcgtgaggtcctctgtgccaccttccatcaggtagctgtcaccgaggagcatgttgcagtgccgggtgggggctgccttgcatgcaaggagcctggcagcagcggagggcaaggctttgagtgaggcggcccggacagccatagctgaggagcatggagccactgggagggggcagtgtcaccttttttggccttcttcctgtgtggaaatacagcgcctccggcttgaacctgccactcaggtgtcttgatgtgtcgggggtgtggctgcctgccccctgatgctccctgccccaccctgtgcagtaggaacccagccatggtgaacgaagccagaggaaacagcagcctcaacccctgcttggagggcagtgccagcagtggcagtgagagctccaaagatagttc

SEQ ID NO: 153410 - DNA, 870 bp, Homo sapiens
  Payload ID: 10172
  Gene Symbol: MTHFR
  Gene Name: methylenetetrahydrofolate reductase (NAD(P)H)
  ENST ID: ENST00000431243
  CDS Start-End: 782-870
gtccgccgggacctttctgggagtcgtaggcttaatgaccctatgccctctgttggcctgtctgtgccctggtggctctgattacttgtttctgttttttgtttttgtttttttttttgagatggagttttgcttttgtcgcccaggctggagtgctatggcacaatcttggttcactgcaacctctgccttccgggttcaagcgattctcctgcctcagcctccagagtagctgggattacaggcgcccgccaccaaacctggctaatttttatatttttagtagagtcgggatttcaccatgttggccaggctggtctcaaactcctggcctcaggtgatccacccacctcggcctcccaaagtgctgggattacaggtgtgttttttgtttttttaagagatggagtctcgctatgttgcccaggctggccttgaactcctgggctcaggcaatccttctgcctcagccttcccagtagctgggtcactgtgatgatttgaattgaattctgtgatgtgtaagaagagcagcctgcaaggcaagcacagatggggcagcttttgttctgagaaattcgtgcccttactgaacttgggtctggctatttttggaacatggccagcatcaagttctaacccacaacacggtctttttggagtagcatgaattcaggagaaatctggctgcatagtcaagccctcaccccttccatcctgtgcacgaactgtttcaagtaacagatgttccaggcagagccagccagataggaacccagccatggtgaacgaagccagaggaaacagcagcctcaacccctgcttggagggcagtgccagcagtggcagtgagagctccaaagatagttc

SEQ ID NO: 153411 - DNA, 1034 bp, Homo sapiens
  Payload ID: 10172
  Gene Symbol: MTHFR
  Gene Name: methylenetetrahydrofolate reductase (NAD(P)H)
  ENST ID: ENST00000418034
  CDS Start-End: 604-1034
cagtggtgcggccggcggccgagcgttctgagtcacccgggactggagggtgagtgacggcgaggccggggtcgccgggagggagatcctggagccggcaaacaacctcccgggggcaaggacgtgcttgtgggcggggagcgctggaggccggcctgcctctcttcttggggggggctgccgcctcccttgcgcacccttcgcgggattagtgtaactcccaatggctaccacttccagcgaccgccaaccctcaagcgaagactgactttggctccctgcctggacggaggggcccctgagccaggggtgacgatcccgcccctctgaccggcccaggcccgtgtcctcgcccccatcggtgactcagtgacctggtgactggattctcggccacctgggcgccgagacggcttccggctcctgccttttaaacctgcctccccggcgatcacctggagaagagcgctgggcccggggcactgcggtccctggcgcccactgcgtcccgctgcgcacgggggtccgccgggacctttctgggagtcgtaggcttagtatcccagtgcttggcgcagactagttgttcataggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaa

SEQ ID NO: 153412 - DNA, 398 bp, Homo sapiens
  Payload ID: 10172
  Gene Symbol: MTHFR
  Gene Name: methylenetetrahydrofolate reductase (NAD(P)H)
  ENST ID: ENST00000413656
  CDS Start-End: 310-398
ctcagtgaatgttggctatcaccgtgtgccaaactctggggataccccaggcaggacaccggtcctgtctcagggaactggggaaagagaaaggagacaggccttttcacccacagttacaacccagggtgctatgggagtccagctgataacggataaatcgtgggagttggcttacaaatatggcacatgcgtggcatatactaggaatgcaataagtctttgaaaatcagagggtttacaggtggttcagcttcctcctactctaggttctgttccagcaagcaattaacgagtaggaacccagccatggtgaacgaagccagaggaaacagcagcctcaacccctgcttggagggcagtgccagcagtggcagtgagagctccaaagatagttc

SEQ ID NO: 153413 - DNA, 7068 bp, Homo sapiens
  Payload ID: 10173
  Gene Symbol: MMAA
  Gene Name: methylmalonic aciduria (cobalamin deficiency) cblA type
  Uniprot ID: Q8IVH4
  ENST ID: ENST00000281317
  CDS Start-End: 1211-2467
accagtaattcattttttattattctgtattcagtaagaatcaacctgtatcaaatagctgaaaaggcctgaagcctcccaaatgcatatcattacacaaattctgtgtgaggactgacatcttggtttcatatactaattatactgcatgggccccatttataaccatatctactcgtcatttgatcctggctactgccgatggatgctatcttcatcacattatagcaaacatttgggtgattaagtttttctcaaaaattctagattagcatacaacggctttactacttatatgtcatctaagacgttttttaagaattagttactactacgcccaacgcagtgaggtagcaaatattatgcctgtttattttcatctccatttcaggcttgcgcgcctttcccccctcgggacttcccgaggacacccctgcagcagtgagcccgagtcctggctttggctgcatgttaagaaatattaatcaaaatgaatgcgtgccctttaagagaaaaaaactgtgggtccttcagcctttaaaaaccatgccgtggtttaaaaacttaaaactatatttcggcagaacgctgagcatttcttcaaatcactctgagaagcttgagtgtctttaatttcaccggtctgtcaaacgtaacgcgtctctccctcaccccacattttaagtttccaaggagcggaagaagggcctccgggggtcccggccgccgcaggctgctgggggtgaggacacgactcggcctccgtccgactcgagggtgtcgcgaaggccaggagggaacgaaagttaccctcgaacttcggaggcgaaagatttcatgtggatcttaaaaagggcaaaacctaccccaaaggccgtaaaccgccctcccctcccccgccagagaacttcccggcgcagagcttccgcagcctgctgcaggccgggagaccttcacgctcactcgctctccgccacacgccggaactgcgcggccacgtccacggggaccctggccatgccccgcaccgccacccagccccaggcgatccccgggccccacgcgcctgcagtcggcgctgcgcctgcgtgggaggatccggcggaaggggcggggtcaggtggcacttccgtggcttcgggcggggaggtcacaatcacattgagccaaaacgcatccagtgttttctccagttacaaataaaacgaatatgcccatgctgctaccacatcctcaccagcatttcctaaaaggccttttaagagcacctttccgatgttaccacttcatctttcactcaagtactcatctcggatcaggaatcccatgtgctcagccgtttaattctcttggactccattgtacaaagtggatgctgctgtcagatggcttaaagagaaaattatgtgtacaaacaaccttaaaggaccacacagaaggactttctgataaagagcaaagatttgtggataaactttatactggtttaatccaagggcaaagggcctgtttagcagaggccataactcttgtagaatcaactcacagcaggaaaaaggagttagcccaggtgcttcttcagaaagtattactttaccacagagaacaagaacaatcaaataaaggaaaaccactagcatttcgagtaggattgtctgggccccctggtgctggaaaatcaacatttatagaatattttggaaaaatgcttactgagagagggcacaaattatctgtgctagctgtggacccttcttcttgtactagtggtggatcactcttaggtgataaaacccgaatgactgagttatcaagagatatgaatgcatacatcaggccatctcctactagaggaactttaggaggcgtgacaaggaccacaaatgaagctattctgttgtgtgaaggagcgggatatgacataattcttattgaaaccgttggtgtgggtcagtcggagtttgctgttgctgacatggttgacatgtttgttttactactgccaccagcaggaggagatgagctgcagggtatcaaaaggggtataatcgagatggcagatctggtagctgtaactaaatctgatggagacttgattgtgccagctcgaaggatacaagcggaatatgtgagtgcactgaaattactccgcaaacgttcacaagtctggaaaccaaaggtaattcgtatttctgcccgaagtggagaggggatctctgaaatgtgggataaaatgaaagatttccaggacctaatgcttgccagtggggagctgactgccaaacgacggaagcaacagaaagtttggatgtggaatctcattcaggaaagtgtgttagagcatttcaggacccaccccacagtccgggaacagattccacttctggaacaaaaggttctcattggggccctgtccccaggactagcagcagacttcttgttaaaagcttttaaaagcagagactaataaaattcatcctgtataataattttacatatcatttcataaagtattttaatagaaaaatcacttgtatgcttatattttcagtaattattgtatggtgctcttgtcttctttgtttgtgacccatgcttgaaaacttgaaggaagttagatatgaatggcaaaagttaggcagtatttataaggtacctgttttatgttactgatatctgtttccttctcttcttataccctggcatggtggcctgtagggtagtttcttcttaatagtcaagaacagagaaagctgaggagagcagaaaatatcttgcactttaaaatgcttattttgattccatattatctgaatttccagagaggatgtaaacaagagtgaccatatttttggagtccttcttgaagccagaacaacacacagtgggttgctaagagccgacaatcataattgacatttagtgtaccagattattctaagaatttctgaaattaccatgtacatgagtaatgaaacaactggaataatgtgatgatgtgaacacaattttaaagtctgcttgtctggatttgcaggtacccttccgccaccccccaacatgataggtaagagagcaaaagggaactgggaaaaatcagctacaaataaaatgggtgactaatccccagttcttggacccattatatttgtagccaattggagtaaacccctaaaagacaaagtgaggtcagaatgattcaaggattattcagtttgaagactaccaaaggcttttgcttctcttcttccttggccatttcacttcattttagtattttaaaaatcttttttcttgatggtgaacaagttttgtcctatgctatggaggaggcatagcacagtgattaagagcttgggctctgtagttggactatgtgggtttaaactttaaacccagatcaattgtatattagctacatgagctaatctctttaagcttccatttcctccctggtaaaatgaaattggcaaataactttctaaggttagtgaagataggaaatactcgaaggctgcttactatccttattacattaaagttatgggtatcttgaaactacaaacctgatgtataatttcagttttctctcatggtcttgttactaccatcatactcttgatattttaggatactttaggattacctttgaagaaccctttctagttaattctttgaatatgttttatacttatttgatggtagttgtaactgtgtacatttgaataaaatttctaaccataaaatttcgccattgcacaaaaagcctttatagaagtttctaacatattctattctgaaccctgtagaatattttatgtagtatagcagcttgcattgttacttactgtactggaatcaaacctcttgagcattattttaacaaacatccctttacattttttggaaagatttttagtactccattggcatagctatttcatacaaggattaggagaaactttgaaaggttatccacttgacttttctgattttagaaaggactaccattaaaccaccctatcagacaaaaaaaactggtttttagaaacctgagagaaggaattttataatttccctgagtaagctgttacagggaataacaaatctcctgccacatgtggcacagtgtaagtaatgctggagcacacatactgcattgtaaagaaggtaggaaaggtggggggacttttgttagctttaattttaaggctaaaagcatttcttctcagtttgaactacttttaaatgttataaatgtcatcataaaaatcattagaaaactcatttctccttatgttgtcgttgtaccattgggtattgtatagagaccaatttctaagagattttttcacctctgtttctgttatttgctatactggaggtaatataataataatgaaatatagctttttttttcaactcagaaatcctattccctctccccatctgtgattatattgtactggacttctgacttggtcaaaagcataggttttgacttagatacatgtgggggcagatctcagctctatcactaactagctatatgatatttggcaagttttttctctatgtgcagtagtttctttatctgtaaaattaagataatagctactttacagggttggaagaattaatttagaaattgtacagtgcttagcctcaataattggtaggtggtggtgtaaatattttacatagatacttgtgacagttctttgttctacaaaacagactaatattaatttcagattggccaagctacttaatttctctgtgcctcagtttcctcactattaaatggggatgacaatagtgtccacctagagcaggactattttagtattacatataatccttggatataaatgctgatgaagtttggatatttgtccccacccaagtctcatgttgaaatgtaatccccaatcttggaggtggagcctggtgggaggtgtatggattagatcagatctctcatgaatgacttgggccatcctttgggtggtaagtgagctcttgctccgagttcacacgaggtctagatctggtcatttaaaagtgtgtggcatctccccatccctcactctatcacttgctcctactttcgtcatatgacatgcctgctcccctttcaccttctgccatgattgtaagcttcctgaggcctccctagaagctgagcagatgccagcaccatgcttcctgtagtctgtagaaccataagccaaataaacatcttttctttataaatttataaattacccagtcgcagatatttatagaaagaacagcctaatacaggtgctaaatacatatctgacaataaatggtagttatctcttagaactgttatgaggattaaacgagttacagtgtccatcttaaaaagataattctgaaaaaaatctcataggttcactttgccttgtcaagaatatgattaccattaacttctgtagataggaaaaaaatgtgctgagctccaaaactgacagacattttgctaaaacaatatcaaatctcattaaaatgatgacagttatttcaatagttgacagtagctatcccaatacaacctaacaaggcattttctcttcagaatcactcgatcatatggccatttccctaagcttttatagctattgcccagtgtacactgaagacaacagctaacgaacaacatacgtgtgataatttatgtagttgaacctctaaggcaaaaaaaaaaaaaaaaaggaaaaattagtgaaaatcattcaaacattatgctcaccaggtagactgccatcatagaagtcctaatgctactgctaaaaactagtaaactaccagtaaactgtgaagacagaagtaactcctgtgatctatatgtttgtgcagatggtggagcttttctgctcctaaagcctgagaaatgcaaatgtggcttcgttaatgcaaatgcttcctacgccagactttatgaaactcctcctaaagttgaattcttatccaagtggacatatgttagggtgccattgtaattcaggtagagtgtcagagtggtggctggcaccaacggtagatgttctcaacattagcgttattcaggtaagactacaacaatgatgaacatgtcaaaactttcctttaaaaggaacaatcagaaaaactctttaacaaatgtttttctttccgtagtattttaattaaaatttttaaaattttaaaatttactaaatttatgaacgtttttatcccacttgagatgaatacttatttatagtccctgtcccatgaagcttctgtggatttgctttgtttgtcatttgtggtatgtttgataacaaaaatattagtggcacaaaagcagttatattgaatgcttttgttttagagaaaatttcactctgtactagaaaatgtagatgatgtgagtcaaagttcattaatatttacctgaaaatttgtgtataaaggtaaccttggggcagtttattttgcttagacccctcagcttcttgatagagtgaggtgagggcatatgtaagtcagtaaactattctgttagtaaagtcaaaggcgtaatctaaattaattatgcttttaactaacacagaagaaatcatgtgacctcattctcaaagctcgtaacatccacctggccaatcttaagatgtggatagagttcttttttttcttttttcaatttttacaataatttttgacacattgaagctgtgcatgtttatgggggcacaatttgatgtttcaatacatgtatatgttgtgtaatgatcaaatcggagtacttagcatatctatcatctcgtgcatttatcatttctttgtggcgagaacatttaaaaatcctattttctagctattttgtaatatacactaccttactgttgcgaaccatagtcaccctactgtgcaatagaacacctgaacttattcctcctatctagttgtaactttgtacccattgaccccccttcccttccttccactctcccctccccagtctctggtaaccactgttctgttccctatgagataaaactttttttgtcttccata

SEQ ID NO: 153414 - DNA, 1352 bp, Homo sapiens
  Payload ID: 10173
  Gene Symbol: MMAA
  Gene Name: methylmalonic aciduria (cobalamin deficiency) cblA type
  ENST ID: ENST00000511969
  CDS Start-End: 48-830
gagccaaaacgcatccagtgttttctccagttacaaataaaacgaatatgcccatgctgctaccacatcctcaccagcatttcctaaaaggccttttaagagcacctttccgatgttaccacttcatctttcactcaagtactcatctcggatcaggaatcccatgtgctcagccgtttaattctcttggactccattgtacaaagtggatgctgctgtcagatggcttaaagagaaaattatgtgtacaaacaaccttaaaggaccacacagaaggactttctgataaagagcaaagatttgtggataaactttatactggtttaatccaagggcaaagggcctgtttagcagaggccataactcttgtagaatcaactcacagcaggaaaaaggagttagcccaggtgcttcttcagaaagtattactttaccacagagaacaagaacaatcaaataaaggaaaaccactagcatttcgagtaggattgtctgggccccctggtgctggaaaatcaacatttatagaatattttggaaaaatgcttactgagagagggcacaaattatctgtgctagctgtggacccttcttcttgtactagtggtggatcactcttaggtgataaaacccgaatgactgagttatcaagagatatgaatgcatacatcaggccatctcctactagaggaactttaggaggcgtgacaaggaccacaaatgaagctattctgttgtgtgaaggagcgggatatgacataattcttattgaaaccgttgggtatcaaaaggggtataatcgagatggcagatctggtagctgtaactaaatctgatggagacttgattgtgccagctcgaaggatacaagcggaatatgtgagtgcactgaaattactccgcaaacgttcacaagtctggaaaccaaaggtaattcgtatttctgcccgaagtggagaggggatctctgaaatgtgggataaaatgaaagatttccaggacctaatgcttgccagtggggagctgactgccaaacgacggaagcaacagaaagtttggatgtggaatctcattcaggaaagtgtgttagagcatttcaggacccaccccacagtccgggaacagattccacttctggaacaaaaggttctcattggggccctgtccccaggactagcagcagacttcttgttaaaagcttttaaaagcagagactaataaaattcatcctgtataataattttacatatcatttcataaagtattttaatagaaaaatcacttgtatgcttatattttcagtaattattgtatggtgctcttgtcttctttgtttgtgacccatgcttgaa

SEQ ID NO: 153415 - DNA, 1437 bp, Homo sapiens
  Payload ID: 10173
  Gene Symbol: MMAA
  Gene Name: methylmalonic aciduria (cobalamin deficiency) cblA type
  ENST ID: ENST00000541599
  CDS Start-End: 48-1322
gagccaaaacgcatccagtgttttctccagttacaaataaaacgaatatgcccatgctgctaccacatcctcaccagcatttcctaaaaggccttttaagagcacctttccgatgttaccacttcatctttcactcaagtactcatctcggatcaggaatcccatgtgctcagccgtttaattctcttggactccattgtacaaagtggatgctgctgtcagatggcttaaagagaaaattatgtgtacaaacaaccttaaaggaccacacagaaggactttctgataaagagcaaagatttgtggataaactttatactggtttaatccaagggcaaagggcctgtttagcagaggccataactcttgtagaatcaactcacagcaggaaaaaggagttagcccaggtgcttcttcagaaagtattactttaccacagagaacaagaacaatcaaataaaggaaaaccactagcatttcgagtaggattgtctgggccccctggtgctggaaaatcaacatttatagaatattttggaaaaatgcttactgagagagggcacaaattatctgtgctagctgtggacccttcttcttgtactagtggtggatcactcttaggtgataaaacccgaatgactgagttatcaagagatatgaatgcatacatcaggccatctcctactagaggaactttaggaggcgtgacaaggaccacaaatgaagctattctgttgtgtgaaggagcgggatatgacataattcttattgaaaccgttggtgtgggtcagtcggagtttgctgttgctgacatggttgacatgtttgttttactactgccaccagcaggaggagatgagctgcagggtatcaaaaggggtataatcgagatggcagatctggtagctgtaactaaatctgatggagacttgattgtgccagctcgaaggatacaagcggaatatgtgagtgcactgaaattactccgcaaacgttcacaagtctggaaaccaaaggtaattcgtatttctgcccgaagtggagaggggatctctgaaatgtgggataaaatgaaagatttccaggacctaatgcttgccagtggggagctgactgccaaacgacggaagcaacagaaagtttggatgtggaatctcattcaggaaagtgtgttagagcatttcaggacccaccccacagtccgggaacagattccacttctggaacaaaaggttctcattggggccctgtccccaggactagcagcagacttcttgttaaaagctttaaaagcagagactaataaaattcatcctgtataataattttacatatcatttcataaagtattttaatagaaaaatcacttgtatgcttatattttcagtaattattgtatggtgctcttgtcttctttgtttgtgacccatgcttgaa

SEQ ID NO: 153416 - DNA, 561 bp, Homo sapiens
  Payload ID: 10174
  Gene Symbol: MMAB
  Gene Name: methylmalonic aciduria (cobalamin deficiency) cblB type
  ENST ID: ENST00000420167
  CDS Start-End: 18-311
gtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagagacggggatttgccatgttggccaggctagtctcgaactcctggcctcaagtgatctgcccaccatggcctcccaaagtcctgggattacagtgtgagccactgcacctggcctgtaattggggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggaggctcacttaa

SEQ ID NO: 153417 - DNA, 1089 bp, Homo sapiens
  Payload ID: 10174
  Gene Symbol: MMAB
  Gene Name: methylmalonic aciduria (cobalamin deficiency) cblB type
  ENST ID: ENST00000544051
  CDS Start-End: 35-178
tggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttgacagacgctgtcctccagttccccaagtccctccaggtcctcaccggtccctcccagccctgcccactctggagcagcgtgcccgtcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacatgaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgat

SEQ ID NO: 153418 - DNA, 1188 bp, Homo sapiens
  Payload ID: 10174
  Gene Symbol: MMAB
  Gene Name: methylmalonic aciduria (cobalamin deficiency) cblB type
  ENST ID: ENST00000537496
  CDS Start-End: 24-545
ggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttgacagacgctgtcctccagttccccaagtccctccaggtcctcaccggtccctcccagccctgcccactctggagcagcgtgcccgtcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacatgaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaag

SEQ ID NO: 153419 - DNA, 4438 bp, Homo sapiens
  Payload ID: 10174
  Gene Symbol: MMAB
  Gene Name: methylmalonic aciduria (cobalamin deficiency) cblB type
  Uniprot ID: Q96EY8
  ENST ID: ENST00000545712
  CDS Start-End: 395-1147
cctgccgccgccgccgcctccccggccgccgcccctccgcgccgaagccggagcagctccccaactcccacaacccagagcgcccgtgcctcaaggggaggaggcgttgtacttcaggccagccaatcagagcgcgcgagcccggagtacctttaccaataggcttgaacattggtcaataggtgttgcagccaagccgacacgggttttcccgccccgctccttccgttaaaccaatgggaaacaagtccctgggagtgtcccgccctggggtgagaactgcgaaccaataaaaattgaaacctgagcggtggcgcggccagctgtgggtggagtcaccccgcggactggacgggaacctggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacatgaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctggagccgtgtgtgtgtgtgtgtgtgtgtgtgtgtgtgtgtgtgtgtgtgtgagagagagccctcccactgccagctcaggttgttcacagatttggaatgggaccagaggcccttgaaaatgtaattgtgatttacctgtgccaaaggtgctttaaatgtcacatttgtaaaggggaaggcggacaagatttggaagtttagtcacctctgagccacccatcaccgccaaagtgtgggggaaggatagctgcagattgacaggcgaggctcagaaactcctggcttagattgaagtgtgtgtgatgggggtgcagcttagaggaccccctctgaaagggatggagatgctgatgagaacaacactaccacttgaaggtgaacattccctgtctggttggactgagtcaagggtctgcggtgcagcatcttcagcttgagaaaatgaggttgtcagtttccagcaaggctgacatccaccagactgatttctccgatgttgcacttggctggcttatgcctctgagatcggtgccacggctgtatttatttcagttgtcactgctgctccctcctgctatgaaacgacactgccagtgccagcagtgtccttgggaaaggcaatatttatgaagggcagaagaggcagccccaagaacctaaagactgcaggctgctaattgcaggaaatgactttggaagggcaggctcttgtccagtttcagggctgaaatgcctggcgaactccattcagccatcacatattgactgagtggctgcttagcatgggccaccgcgctaggctcgggacagctggtctttccggccatctttcttgctggcaagtcagcaaacattaccttcttagtcacgtgcatatttttgccttcattcttaccacctggcctgcaaagtttgcaggagggccaggtatattcacttgtgtcttctgggtcctttcattgctgacaggctgtgatggccctcttgagccttgggcagggtgggtgaggtgcagatgaccaggagtgtgtgaatgccttccaggaggtggctttgttccgtgcctccctgcccccatcgtcactaccaggtctggtacggagtcggtgctcagtgtttgcaaaacagagctgaaaacggactttgggaggccgaggcaggcagatcacctgaggtcaggagtttgagaccagcctggtcaacatggtaaaaccccatttctgctaaaaaaaaaaaaaaaaaaaaaaaattagctgggcatggtggcgggtgcctgtaatcccagctattcaggaggctgaggcaggagaatcacttgaacctacgaggcagaggctgcagtgagccaagatcgtgacacgacactccagcctggctgatagagtgagactccgtcacaaaaaaaaaaaaaaaaaaaaaaaaaccctgaaaacgcaatcactaaggctcggtcagggagtatgttcaaagagcttgcagcgaatcactcaattctgtctacacctcaaaatctcaaaatcttcctggaatatatatatatatataaaataacacagcagccctgcatgcctagccatgggaaagcacagcctccaaaggataaggaaagctttttgagtaaatacaacatcctaaagtgacaatctttgaaacaaggccgttcacctgttgccaagtcctgtccttccaggaccgggtgtcacagcctggatgttaacagtcgcgttctcagacccccgcctctgtatctgtctcccggttcaccagcaaacacttctctgagaaaccacctgggtgcagggcagatgccaccactcagcaggtgtttctctcctgtgctaccaacctgggaaaaatggagaaagcttgctttgggggctggaaggatggggtgtttaaaacatttgctcttctgcagtgcctttcaaaagctctatcaagagcccgaggcaaaagaaaagatgtgtacccctctgtacactgagcaaatgtcctcccatattttgaaccaggtgggaaaagttaatgaaagccctacagtcaggaaatgtgactgcgaagcccccgctgccccagtgtttgcacaccactggcaactctcagaaacaatcagtcccattgcacgggaacacggggttttgaaacaaacagcagcctgtttttatttaaagtcgtgatcccttgcttatcgtagatttttttcataatttgattttggaaaatattgcacacaaatactactcgatccctgagtttgtgggcacttccttacattttgcacccatgaaaatgcctcctccgcctccaggtcaggctccctggaatggggtgtttagtgtcatttccagagacaagctggcagttggctcttgtgtcagagagaagcccacagtcacagtgacaccagcccgcactgtggaagggcttgctatgtgcagtgccctgagccaagtgttccacagacattatctcatttgaaccccatagcagccctggaaggaggcattgggtggggaaccaagttgtcctggggagtcagtgccaagatgtgagccccggacgcggcctcgtcactcacagccccgtgctcctcagctcccacccactgccgcttgacagtcgttttaatcactacctgggctgtggcgaacaatgccaggctctgatagatcctgctgtctcatttctcaacctagtttcccttaactaatatttcatggctatcgttaatgtgcgtttttcatcgagtaatttccacagcccgaacttgtaacacatcccaatgacaaacgtccccagttcggaagcccccgtcagtggcaatgtcacccttgctgctgcctcgacaccttccgacagcccattcagttttatgatcgccctgtcccagtgatcactactgaacctttaagaatccagatgcatttcaagtttaattgaataaaattctttgtataataaa

SEQ ID NO: 153420 - DNA, 945 bp, Homo sapiens
  Payload ID: 10174
  Gene Symbol: MMAB
  Gene Name: methylmalonic aciduria (cobalamin deficiency) cblB type
  ENST ID: ENST00000540016
  CDS Start-End: 18-614
gtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggtttgctctggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacatgaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctgga

SEQ ID NO: 153421 - DNA, 546 bp, Homo sapiens
  Payload ID: 10174
  Gene Symbol: MMAB
  Gene Name: methylmalonic aciduria (cobalamin deficiency) cblB type
  ENST ID: ENST00000503497
  CDS Start-End: 25-471
aggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattggacggagtttcgcgcttgttgcccagactggagtgcaatggtgtgatctcggctcactgcaacctctgcctcccgggttcaagcgagtctcctcattattactattcttaacacttacctgttcctggctaccatttctccatggcgggcctgactaggtttgctctggaattagtcacagaaaagggccatacatttgccgaagagcttcagaaaatccagtgcacattgca

SEQ ID NO: 153422 - DNA, 1252 bp, Homo sapiens
  Payload ID: 10174
  Gene Symbol: MMAB
  Gene Name: methylmalonic aciduria (cobalamin deficiency) cblB type
  ENST ID: ENST00000541763
  CDS Start-End: 1-522
atggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttgacagacgctgtcctccagttccccaagtccctccaggtcctcaccggtccctcccagccctgcccactctggagcagcgtgcccggtgggtgtgccgtggcagggctcctggaggcagaacactgcccggtttggggggcagggctggacttcagaggagctcctgtccgcagtgggcacacctttcccaccctgctcaggcaatgtccctttctcctttcagtcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacatgaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagt

SEQ ID NO: 153423 - DNA, 1342 bp, Homo sapiens
  Payload ID: 10174
  Gene Symbol: MMAB
  Gene Name: methylmalonic aciduria (cobalamin deficiency) cblB type
  ENST ID: ENST00000537236
  CDS Start-End: 101-394
aattgaaacctgagcggtggcgcggccagctgtgggtggagtcaccccgcggactggacgggaacctggcggggtcaggtcccgtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtaagggggacaggattggccttgaggttgcgtttgagtcgagtatgagtaaacgtaatgaatgtgaagctctcacgcatgctgggcagcagcctcggaggttgtcagcccttattgaactttcctcagccctgaagcacaggctggtcagctccacaaggctgtggggctgcagactcctttcccttctggccctgcctgtgcctgcgctggcctctggcccatgccatgtgaagctgcctccctctcatccctcacttttcaggtgagcctgtgtgtgccactgaggttagtatactgagtgaaagaggtgagttagtataatgcacagtacatccaatgtgatcccttttgtgactgttgttttttacataagccaaagtttagaaggtggactcaaggatggaccagatcaggatgggccaggtcatgctgtgatcacagacaaccccaaaatctcctgacttatgacaccaaagatggacttgctgttcccacttcatgcccatcacagggtatattctttggctccatgcggccttcattctgggacacaggctgctagtacagctgctgcctggggcaattatcagtcattgtggcagagggaaaagaggtcatggtgaagctcacattggctcctgacgctgccaggggattgtgcagtgtcagtgttgtcgccagtgaggtttacccaagatgtgattattgctgattgaaaacttttcccactaccccaccatgatgacttgaaatatagtcaacattggcagtttttgacagtctttatggagactaaactttgttggtaaataaaagttgaaaaaaaaatgactaggtgcagcggctcacatgtctaatcccagcgctttgggaggccgaggtgggagaatcacttgagctcaggagtttgagaccagcctgagcaacatagcaagacttcatctctact

SEQ ID NO: 153424 - DNA, 5296 bp, Homo sapiens
  Payload ID: 10175
  Gene Symbol: MMACHC
  Gene Name: methylmalonic aciduria (cobalamin deficiency) cblC type, with homocystinuria
  Uniprot ID: Q9Y4U1
  ENST ID: ENST00000401061
  CDS Start-End: 281-1129
ggcgatggaggcggtggaactacctttctctagaagagacacgtacatgcacacccccaccgtgtagcttgccgggaaactgagtcttcctgatttcgtgtggctgtctccaaggaggaaacgaactacgcatcccaagatgcatcgcgcataggcaatatggtcccgctactggacccatttcctacctgggaaatggagtcgaagctgactcaaaacgtaacggcccaattgtccttgagacttcattccccagcaagctcagcgtgtaacgtgcgctatggagccgaaagtcgcagagctgaagcagaagatcgaggacacgctatgtccttttggcttcgaggtttaccccttccaggtggcatggtacaatgaactcttgcctccagccttccacctaccgctgccaggacctaccctggccttcctggtactcagcacgcctgccatgtttgaccgggccctcaagcccttcttgcagagctgccacctccgaatgctgactgacccagtggaccagtgtgtggcctaccatctgggccgtgttagagagagcctcccagagctgcagatagaaatcattgctgactacgaggtgcaccccaaccgacgccccaagatcctggcccagacagcagcccatgtagctggggctgcttactactaccaacgacaagatgtggaggctgacccatgggggaaccagcgcatatcaggtgtgtgcatacacccccgatttgggggctggtttgccatccgaggggtagtgctgctgccagggatagaggtgccagatctgccacccagaaaacctcatgactgtgtacctacaagagctgaccgtatcgccctactcgaaggcttcaatttccactggcgtgattggacttaccgggatgctgtgacaccccaggagcgctactcagaagagcagaaggcctacttctccactccacctgcccaacgattggccctattgggcttggctcagccctcagagaagcctagttctccctccccggaccttccctttaccacacccgcccccaagaagcctgggaatcccagcagagcccggagctggctcagccccagggtctcaccacctgcatcccctggcccttgattttctcccatgtggaccctgatttatggtggtacttgctaggacttaattggctttggcaaagcaaaaggttttgagtacaagattactatttttgataatatagtagagatcttccatgaagataacaaggctcaaggaagttaggtttggccaagataaaggccagggaaccagaattcccatctgccttcaaatgagttttttttttttttttagacagagtcttactctgtcacctaggctggagtgcagtggcacagtctctactcactgcaacctctgcctcctgggttcaagcaattatctgcctcagcctcctgagtagctgggatgacaggtgcctgccactacacctggctaattttttgtatttttagtagagatggggtttcatcatattggccaggctggtctttaactcctgacctcgtgatccacccatcttggcctcccaaagtcctgggattacaggaatgagccaccgcacccagccaagactctatctgttcccatttctaagcagttccccaagatgttgttacagggcctaaggggcaaatatcctctaaagagtacctaccagcagggtgtggtggctcccgcctgtaatcccagcactctgggaggccgaggcaggtggatcatgaggtcgagtttgagaccagcctggccaatacagtgaaaccccgtctctactaaaaatgcaaagttagccgggcatggtagcgcaggcctgtagtcccagctactcaggaggctgaggcagtagaatcatttgaaccagggaggcagagattgcagtgagccgagattgcatggctgcactctagcctgggtgacagtgtgagactctgtctcaaaaaaaaaaaaaaaagtacctacctcaggtagggactgaataaacacgtgtaaggcactttggaaaaatacctggcatatatagtaagcagtatgttggccattaccaaaggccctgggaattctgtactgctgctcatgggtgtagtcggttctagaggggtgggcaggtgggagtagctgaggaagacaagtggctggaatggtatcacatgatacacagaagtatcctcagttctgaatctaccttggcctcaagggcccaggagaataacttttcccagctgacagcctctctgaggacaatgacatatgaatgaggatcaaaacgagctttggccaggcactgtggcgctcacctgtaatcccaccattttgggaggctgaggcggaggaccgcctgaggcaaggaattcagaaccactctgggcaacataatgacactaaaaaagactatctctaatcaaggctagaaccaagggaaggctaagaattgcccagtactgtgcaactacgaaagccctacccaaggccaccagccttgtcttcctctttcctctgtcagttcaaaaagaacagaaacctccagctcttttacatagcaggtaccaggcatttatcagaagaggccaagcttctggttcccatgcagccctttgaatagtgtgtctaaacaaaaataggtgtccaagtagtcacactgagactttaactggtaacccagcctgtggcgtcagtcgcagtgctctggccaacactatagcagggcttattcttctccctcatgtgtagtgaaacaaaatgtaacaccttgggttcattcagttccattccctatatctacctgtgtcaatataattccctgatttggaggcagctctcctcattttccccaaaacagggaaagcaaggagtaaattcctcttaaaatcaaaagctaataatatgcttcctaaaataaagactcatcaaggtctcagttcaagtttaatacaaactacaaaagattaatgggttgctctactaatacatcatacaaaccagtagcctgcccacaacgccaactcaggccattcctaccaaaggaagaaaggctggtctctccaccccctgtaggaaaggcctgccttgtaagacaccacaattcggctgaatctgaagtcttgtgttttactaatggaaaaaaaaaatacagaagaggttttgttctcatggctgcccaccgcagcctggcactaaaacagcccagcgctcacttctgcttggagaaatattctttgctcttttggacatcaggcttgatggtatcactgccaggtttccagccagctgggcacactgcaagagaaaggcaccactaattaataaccttctcaatggtatgcaccaccattctcctatggacaaaaccagttctgcacctgaacactcagataccaggaaacctacccctgcaatcagtcttagatcattcacccttttagtatgagctaaccattttacaaacatataatcatcaccacagccttaagatactatcatgcctaatttattcatgtagcacttgaaatttaaattttccacaaaaaaaggcaaagtttaaataatttgccaacactctctaatccttaaggggaaaaaaaagctaaataaacgacacacataggactatgtaaacccttaacactaaactgtttctgacagcccttcagagctctgaagacagcaaactcagtctgccttctcagcattcttctaactctaccaaactggatagcctgaaccttataaaggatcaagaacttaacagaagcccccgcttgtttcattaagtaactgccatctaccccttggtaagcaaaaggcagagtttgaaatttttcatagatttatacagaaagcacagccttcaaccttttcctgacaatgcctaagaatgtgcctcaggctagcctgaagaaaatgaggcaaggggactaatctcttatttttctttttttttttttttttttttttttttgagatggagtctccctctgttgcccaggctggagtacggtggcgcaatctccacctccgtctcactgcaacctcggtctcccgggttcaagcgattctcctgcatcagcctcccaaatagctaggattacaggcgcccaccaccacacctggctaatttttgagacagtctcacattgtcgcccaggctggagtgcagtggcgcgatctcagctcactgcaagctccacctccggggttcatgccattctcctgcctcagcctcccgagtagctgggactatacaaaaatagtggggcgtggtggtggacccctgtagtcctagctactcaggaggctgaggcaagagaatcacttgaacccaggaggtggaggctgcagtgagctgagatcacaccactgcactccagtctgggcgacaaaacaagactctgtctcaaaaaaaaaaagtgtttggcattcattggctcttaaatggtacctatttaagaggctgtacatgttccagtgggatgggaagcagcagagaccaacagagtctgaagaagcaagcttctgagttatgaaagcctgggttcaggagactaacctatatgtaggttcctaggaaagtccagttaaagggcctactttgccactgctgcctccttcttaatgctgaacctcatctcccacaagggggcagtctcagcaggtgtcagctgagccatgtgtcatctgtccaggctaactgcccacacatccttctgcaaagggtacctcttggttatcagtgctcactgatccctatataatcagactctaatccctgtaaaaagattacttggtgctagccaagctagcacctttgggtcttcccaaacatacaccactaatccagactctaataacttcatttcctttaaattacaagatcagagctgaaataggccttagaaagctagtctgggctgggcgcaatggctcaggggaggcggaggttgcagtgagccaagactgcgccactgcactccagcctgggcaacagagcaagactccatcttgcaaaaaataaataaataaataaaaatatgaactatatggattaacctcttctctcaataaagttatttaaaaaatggcatgctttatctctagaggtgattcccaaccattttgttttgccctaatacatctgtgagatcatcctacattcagtaagttagatctttgggagtgactgattctaaatgagcaggacagaagagaggagtatgtatactttgaataaaaagcctttatattctc

SEQ ID NO: 153425 - DNA, 1510 bp, Homo sapiens
  Payload ID: 10175
  Gene Symbol: MMACHC
  Gene Name: methylmalonic aciduria (cobalamin deficiency) cblC type, with homocystinuria
  ENST ID: ENST00000616135
  CDS Start-End: 164-841
gaaagtcgcagagctgaagcagaagatcgaggacacgctatgtccttttggcttcgaggtttaccccttccaggtggcatggtacaatgaactcttgcctccagccttccacctaccgctgccaggacctaccctggccttcctggtactcagcacgcctgccatgtttgaccgggccctcaagcccttcttgcagagctgccacctccgaatgctgactgacccagtggaccagtgtgtggcctaccatctgggccgtgttagagagagcctcccagagctgcagatagaaatcattgctgactacgaggtgcaccccaaccgacgccccaagatcctggcccagacagcagcccatgtagctggggctgcttactactaccaacgacaagatgtggaggctgacccatgggggaaccagcgcatatcaggtgtgtgcatacacccccgatttgggggctggtttgccatccgaggggtagtgctgctgccagggatagaggtgccagatctgccacccagaaaacctcatgactgtgtacctacaagagctgaccgtatcgccctactcgaaggcttcaatttccactggcgtgattggacttaccgggatgctgtgacaccccaggagcgctactcagaagagcagaaggcctacttctccactccacctgcccaacgattggccctattgggcttggctcagccctcagagaagcctagttctccctccccggaccttccctttaccacacccgcccccaagaagcctgggaatcccagcagagcccggagctggctcagccccagggtctcaccacctgcatcccctggcccttgattttctcccatgtggaccctgatttatggtggtacttgctaggacttaattggctttggcaaagcaaaaggttttgagtacaagattactatttttgataatatagtagagatcttccatgaagataacaagactatctctaatcaaggctagaaccaagggaaggctaagaattgcccagtactgtgcaactacgaaagccctacccaaggccaccagccttgtcttcctctttcctctgtcagttcaaaaagaacagaaacctccagctcttttacatagcaggtaccaggcatttatcagaagaggccaagcttctggttcccatgcagccctttgaatagtgtgtctaaacaaaaataggtgtccaagtagtcacactgagactttaactggtaacccagcctgtggcgtcagtcgcagtgctctggccaacactatagcagggcttattcttctccctcatgtgtagtgaaacaaaatgtaacaccttgggttcattcagttccattccctatatctacctgtgtcaatataattccctgatttggaggcagctctcctcattttccccaaaacagggaaagcaaggagtaaattcctcttaaaatcaaaagctaataatatgcttcctaaaataaagactcatcaaggtctcagttcaagttt

SEQ ID NO: 153426 - DNA, 1436 bp, Homo sapiens
  Payload ID: 10176
  Gene Symbol: MMADHC
  Gene Name: methylmalonic aciduria (cobalamin deficiency) cblD type, with homocystinuria
  Uniprot ID: Q9H3L0
  ENST ID: ENST00000303319
  CDS Start-End: 206-1096
gcgcgtgcgcatcatcgtttcgacgcgctcggaagcaacttcctttgcctgctcaccgccagcgtaggtgctaccaccgctgccgtcgccgccgccattttgatggcaggaagagtccggttctgggacagctggagacagtggtggtgactgaaataactttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacagacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatatttatttctaagtatttatttcagcatttatgaatttacaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaataa

SEQ ID NO: 153427 - DNA, 1726 bp, Homo sapiens
  Payload ID: 10176
  Gene Symbol: MMADHC
  Gene Name: methylmalonic aciduria (cobalamin deficiency) cblD type, with homocystinuria
  Uniprot ID: Q9H3L0
  ENST ID: ENST00000428879
  CDS Start-End: 506-1396
tcggtattgcccgtattttcactgggtccctgtcgttgtccccagccatcctgtccgtctgtctttagtctcttttctgcttcctcatctttccgatcagcctgaagctttgcttggagctgttgttacgcagccccaacttctgttaaagcagccgcttcgatcctctggactgaattttggccacccagcccccattcccctcccggatctggtccgagttgtttttccgcggctgtaaaccggaagggctctgagctgcactgccggctccgggctgggggatctgtgcctggcatgggggcgagttctggcctccttagggtacggggagagcttggactttggtcctgacgtggtggacgacacaccttcgaagagtggacgttacctcagttgtctgttgttagagtttaatcgatcactcgtctgttttgttgtgttctttcccagaaataactttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacagacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatatttatttctaagtatttatttcagcatttatgaatttacaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttg

SEQ ID NO: 153428 - DNA, 1462 bp, Homo sapiens
  Payload ID: 10176
  Gene Symbol: MMADHC
  Gene Name: methylmalonic aciduria (cobalamin deficiency) cblD type, with homocystinuria
  ENST ID: ENST00000422782
  CDS Start-End: 168-1160
cttcctttgcctgctcaccgccagcgtaggtgctaccaccgctgccgtcgccgccgccattttgatggcaggaagagtccggttctgggacagctggagacagtggtggtgactgaaataactttaccaaaggaaagctattttgcgaactatcttctccagcggagatggccaatgtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacagacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagacggagtctctctcgcccaggccggagtgctgtggcatgatctcagctcactgcaatctctgcctcccgggttcaagcaattcttctgcttcagcctcccgattcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatatttatttctaagtatttatttcagcatttatgaatttacaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattat

SEQ ID NO: 153429 - DNA, 835 bp, Homo sapiens
  Payload ID: 10177
  Gene Symbol: MCEE
  Gene Name: methylmalonyl CoA epimerase
  Uniprot ID: Q96PE7
  ENST ID: ENST00000244217
  CDS Start-End: 19-549
ggcgggttgctttccaaaatggcgcgggtgctgaaggctgcagccgcgaatgccgtagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacagttaaagactgaattacagaaagattaaaatatatacatatataaatacataaatatgtatattatttagattaacaaacatatttgttaatttgaatttgaagaaaatcttgattactaattacttagggaacattattaaaatcatatagaaataaattattcctcttctacaa

SEQ ID NO: 153430 - DNA, 523 bp, Homo sapiens
  Payload ID: 10177
  Gene Symbol: MCEE
  Gene Name: methylmalonyl CoA epimerase
  ENST ID: ENST00000413592
  CDS Start-End: 1-237
ctgggtcgactcaaccatgtagccatagcagtgccagatttggaaaaggctgcagcattttataagaatattctgggggcccaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacagttaaagactgaattacagaaagattaaaatatatacatatataaatacataaatatgtatattatttagattaacaaacatatttgttaatttgaatttgaagaaaatcttgattactaattacttagggaacattattaaaatcatatagaaataaattattcctcttctacaa

SEQ ID NO: 153431 - DNA, 836 bp, Homo sapiens
  Payload ID: 10177
  Gene Symbol: MCEE
  Gene Name: methylmalonyl CoA epimerase
  ENST ID: ENST00000494660
  CDS Start-End: 744-836
gcgggtgctgaaggctgcagccgcgaatgccgtaggtgaataccgggcaccggcgaccttcgccatgggacagggagcgtgggaacggcggtcgggggcggaggaggcctcggcgtggccaaagcaccttgatctaatgtcctcccccgggggcgcgttccacagcagctgctgtcacttaggcagagggtgccttccagaagcgccaccgcttagtagcggggattgccttgtgcatgagtcccatttccatccgagagctgtgcgccttgggctctgcaccttccagtatgtgggcgggagagtcgagggaacttgcccggcaggtcaggcagggcagggacagaagtaaatagaagcggatcggtaagttattttaccgcgcaccaataaagagactggggagaaaccagaaaggagagcacgttccgtaaaaacaacaactactagtcggccgaactccaagcgtgaccagctttctgttgggaacactcaaagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgag

SEQ ID NO: 153432 - DNA, 499 bp, Homo sapiens
  Payload ID: 10177
  Gene Symbol: MCEE
  Gene Name: methylmalonyl CoA epimerase
  ENST ID: ENST00000486135
  CDS Start-End: 407-499
gtggcgggttgctttccaaaatggcgcgggtgctgaaggctgcagccgcgaatgccgtagactggggagaaaccagaaaggagagcacgttccgtaaaaacaacaactactagtcggccgaactccaagcgtgaccagctttctgttgggaacactcaaagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgag

SEQ ID NO: 153433 - DNA, 3749 bp, Homo sapiens
  Payload ID: 10178
  Gene Symbol: MUT
  Gene Name: methylmalonyl CoA mutase
  Uniprot ID: P22033
  ENST ID: ENST00000274813
  CDS Start-End: 129-2381
cctggctgtgtggatgtctgacaggtgaggcgggggacgcagaagtgcagccgccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaagcttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacgttgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcataagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaattta

SEQ ID NO: 153434 - DNA, 3030 bp, Homo sapiens
  Payload ID: 10179
  Gene Symbol: MEPCE
  Gene Name: methylphosphate capping enzyme
  Uniprot ID: Q7L2J0
  ENST ID: ENST00000310512
  CDS Start-End: 389-2458
atttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggcccccacacctgtc

SEQ ID NO: 153435 - DNA, 2261 bp, Homo sapiens
  Payload ID: 10179
  Gene Symbol: MEPCE
  Gene Name: methylphosphate capping enzyme
  Uniprot ID: Q7L2J0
  ENST ID: ENST00000414441
  CDS Start-End: 1036-1698
agtgagcgggcgtcgggagtgggcggatgcgttggggttcgggtcgtgggtgttgaggcggagaggaaggcgtggtgtggcgtctccaggtgattgcgattgggggaaggtagaggagccagagaacgactcagccgtttcgggggaagaggaagttggacaacatcggctgttttagtgctttttatttttccccaattcagcagagaatattttcaagggggcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacgggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagaaacgatctacaagaactactaccgaatccaattgaagccagagcagttcagttcctacctgacatccccagacgtgggcttctccagctatgagcttgtggccacaccccacaacacctctaaaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggccccc

SEQ ID NO: 153436 - DNA, 2269 bp, Homo sapiens
  Payload ID: 10180
  Gene Symbol: MSMO1
  Gene Name: methylsterol monooxygenase 1
  Uniprot ID: Q15800
  ENST ID: ENST00000261507
  CDS Start-End: 174-1055
agctctcgcaggccaataacgacaggacgggccgcctggcccacccggctccacccccaagccaggcgaggcaggttccgaggttggaacacctggcgagtcctcggtgtcggtggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgattatctggtttccagttttaaacattaactgtcaccttttattcttaaacttgaaagtacagaaatcattaaattattaagttgtacaat

SEQ ID NO: 153437 - DNA, 1789 bp, Homo sapiens
  Payload ID: 10180
  Gene Symbol: MSMO1
  Gene Name: methylsterol monooxygenase 1
  Uniprot ID: Q15800
  ENST ID: ENST00000393766
  CDS Start-End: 218-706
aggcgaggcaggttccgaggttggaacacctggcgagtcctcggtgtcggtggccggcagtcatctcgcggccgttcaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtat

SEQ ID NO: 153438 - DNA, 1026 bp, Homo sapiens
  Payload ID: 10180
  Gene Symbol: MSMO1
  Gene Name: methylsterol monooxygenase 1
  ENST ID: ENST00000504317
  CDS Start-End: 76-765
agtcctcggtgtcggtggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccataggtgagtattaatttctgttcaggtataaagcataatgaaatatatttattttcatggccataagattatcatatttctaaggagactaataggagaagttaatcttcttaatgttatattaagaaaacataactgttggataaaagtttaaataatagatgtttttacattctagcctatgctgttataatttttatagtgataatgtgttattagggcaagtatatattcaggaccagcaatttccttatccttctgtaataaa

SEQ ID NO: 153439 - DNA, 482 bp, Homo sapiens
  Payload ID: 10180
  Gene Symbol: MSMO1
  Gene Name: methylsterol monooxygenase 1
  ENST ID: ENST00000505270
  CDS Start-End: 228-482
gaaggtgggcctaggctaaggtacgtgctagaaaggatgaaaacggagtgaaattcttaagtgatggaactaggctagggcatgtttcttgccctttaaaatgtgttgtcttcgggagacaggacgtagaagatagttgcagcacagggtgataggctggcgaaagttatacaaaagcaggaaccactagaaggagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaag

SEQ ID NO: 153440 - DNA, 973 bp, Homo sapiens
  Payload ID: 10180
  Gene Symbol: MSMO1
  Gene Name: methylsterol monooxygenase 1
  ENST ID: ENST00000507013
  CDS Start-End: 312-973
ccggctccacccccaagccaggcgaggcaggttccgaggttggaacacctggcgagtcctcggtgtcggtggccggcagtcatctcgcggccgttcaggtgagggggttggaggagtggctcatgagcgaggaagggggagcaggcgggctcccacccggtgctccgtgagatcgaggggagcgggttctgggtgcggatgcacgcgctgggcgggacgctggcagtggtacccgagacggggcggaaggagactggagtgaaggtgggcctaggctaagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgttt

SEQ ID NO: 153441 - DNA, 6122 bp, Homo sapiens
  Payload ID: 10181
  Gene Symbol: MTAP
  Gene Name: methylthioadenosine phosphorylase
  Uniprot ID: Q13126
  ENST ID: ENST00000380172
  CDS Start-End: 207-1058
gatttggggaaggggtggcgggggagatcccacacaagcagccaatccagctgtcccggggaggaagaggaggagtcaaggcccgcccctggtctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcgtcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtttcggtggaccgggtcttaaagaccctgaaagaaaacgctaataaagccaaaagcttactgctcactaccatacctcagatagggtccacagaatggtcagaaaccctccataacctgaagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatttaatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaattagctgggcgtggtggtgggcacctgtagtcccagctactcaggaggctgaggcaggagaatggtgtgaacctgggaggtggagcttgcagtgagcagagcttgcagtgagacgagcttgtgccactgcactccagcctgggcaacagagtaagactcagtctcaaaaaaaaaaaaaagagtgaaatgctttttgtttgcttcagttttttatcatggggagatctttttcctcagaattgttttcttttcactgtaggctattacaggatacttcaggatcaagatacagaaccttttatttaaagagtttgtaaagtcaatgtgtttgtttgtgtctctgagattgacttcaagataataagctgctaattgtaaacaaaacagttaccctccagtattaatatgactcattagtgtgagccatttgggtcaagtatgattatgacccttggacttcctgatgtagtattaaatttcaactctggttatccattagcaatctgtagagaacttaatgaacctgaacccaggcttctctagctctggtaacgtgtgattgttttcactacaatatgatacatagatggtaccttacttttcctcattcttaataggtgtctaagaatgtcagggcaaaagtatgggcatttttcttgctatgttcagaaagtacagttctctccaacttgcagaggtacttttcttgattaaatagccttctctagcaacatcattttcagactaactaaatgaatgcagtatactcttttctttgttctcaatcattcactccttatgcaaagccaatataattttcctcataccttatgcttgaggatattgttgaagaacacttcctggaacacttctcacttgtgatgctgtactaattttttttttttaatttaagctagtatactaagtgaacaccatggtcagttgtgagcattttggtttccgcaaaggatggatggtgagcatcatgggaaagctgtagtttagtgacttagcccttagtgattaatagatttgcatgtacatagaagtctttgttggccttataatctgctgttatatttggcatggattttcatggttttgagaatgacatcctggccctgtggtccccgagggtcatggtccttgtgacctggcccctgttcactgcccccttcgctagcacgagttgctgtgcagggctggaggtagctaccatggcttgtttcaaggaaggaaactctggtacggtggcaccctcaggagtggaggacagtgaacttccttgaagagggagtgactaaggtgacctccaacctgccctgagccagctgccctgcaggtgccacgtgagcctgctctggcatccacaggatgctcctggagcctcttctctggctgctacctcagggcatggttgtggccccaccaacacctattttccaaataattattcattcttgtgacagtggcctgaacatgtttttaattttctcaacaagcatttagccagcacttatccagtgaaacaatttgataaggtttcaaggagtatctgatgggttaggaagtcacgaaatgaggagttcttgccacatttgcagagtccctccttgataaggtttggcggtgtccccacccaaatctcatgttgaattgtagttcccataatccccacatgttgtgggagggacccagtgggaggtaattaaatcatgggggtggttacccccacactgctgttctcatgatactgagttctcacaagtcctgtttgttttataaggggcttttcccccttttgctcaacacttcttcctgccatcatgtgaagaaggacgtgtttgtttccccttctgccacgattgtaagtttcctgaggccttcccagctatgtggaactgtgagttaattaaacctctttcctttataaattacccagtcatgggcagtcctttacagcagcatgagaatggactaatacactcctcaaatgttttgaagattgttgcaccttggaactaccagtgtgcacacaatctggctcaatgtatatattggcccagcaaggcaaagaactgaagttccaggatggaagaacctgtgttctcctcataatagtatagaataattcaagataggcaagaaggacagcagtaaatgaagaccatggaagaaaagaaggaatgccaaagatcgaggaaatctaccaagactagtagggtagtccagaagaagctgtttcagggcctgttgccagctatgcctttgagaacctcgggatcccaaagaatgaggggaatttcttcagaaagacaatctcggcatgcattatttctttgttttgaagattcactcatgttgcatgcatctgtagcttgtgccttttttattgcctagtagtattctgtcatatgcctatcttacaatttgattatctattcacctgttgatgaatgtttgaattttttccatttgaggaattttatgaataaagctgctataagcatgaaattacaagtctttttgtgaacatattttcacttgtgcaaatgcctatactcccaccagtaatttgtaagaattcttgacaaagcttggtattgtcagcgtttttaattttagccattctattgggtatattttgatatctcgtggttttgatttgcatttttctgattaaagatgttgaacttcttttcatgtgcttattggccattcacatatttcgtgaactatctgtacaaatatttttgtttattaaaaaattagattgttttgttttattattgaatagtaagaattgtttatatattctggatacactctttttcagatatgtgtgttgtgactattcttagtctttagcttgccttttcattttcttaattatgtctttcaaagaacaagtttttcattttgacgaagcctagtttatcaattttttttatggttggtgctttttgtgtgttccaagaaatctttgcctactcatttaattacctgtgtgcccttgtcaaaatcatttaattttgactactcacttaattaccttgcctactcatttaattacctgtgtgcccttgtcaaaatttactgtttatctgtgaatctggatgatctatttatgtcatttatctatgtgtctcttcttatgccagtaccccactgtcttgattattgtggctttatggtgtcttgaaattaagtattgttaagctttgcaatcttttccaagattgttttggctataggtcctttctttataaagtttatattaagcttctccatttttctttaagaaaaaatctgctggaatggcactgaatttttaggtcgatttgggaagaattgacaatattgaacctttcaatcgatggacatggtatgtttctgcatttatttgggccttttaaaatttatctcagcaatattttgtagttttagtgaagaagtcttgtatatatcttttgttaaatgtattcctaaatattttgtggaaatgttactgtaaatagtactttaatttcatttttaagtttattgctggtatacagaaatatgttttatttttgtatattgactttatattctgtaatcttattaaattcacttagttca
